(12) United States Patent
Barghetti et al.

(10) Patent No.: US 12,270,043 B2
(45) Date of Patent: *Apr. 8, 2025

(54) COMPOSITIONS AND METHODS FOR TARGETING, EDITING, OR MODIFYING GENES

(71) Applicant: Celyntra Therapeutics SA, Mont-Saint-Guibert (BE)

(72) Inventors: Andrea Barghetti, Copenhagen (DK); Roland Baumgartner, Angern an der March (AT); Tanya Warnecke, Boulder, CO (US); Kurt Marshall, Boulder, CO (US); John Schiel, Westminster, CO (US); Alyssa Carlson, Westminster, CO (US)

(73) Assignee: Celyntra Therapeutics SA, Mont-Saint-Guiberi (BE)

( * ) Notice: Subject to any disclaimer, the term of this patent is extended or adjusted under 35 U.S.C. 154(b) by 0 days.

This patent is subject to a terminal disclaimer.

(21) Appl. No.: 18/189,201

(22) Filed: Mar. 23, 2023

(65) Prior Publication Data

US 2023/0265461 A1 Aug. 24, 2023

Related U.S. Application Data

(63) Continuation of application No. 17/958,973, filed on Oct. 3, 2022, which is a continuation of application No. PCT/US2022/017582, filed on Feb. 23, 2022.

(60) Provisional application No. 63/285,851, filed on Dec. 3, 2021, provisional application No. 63/153,847, filed on Feb. 25, 2021.

(51) Int. Cl.
*C12N 15/90* (2006.01)
*C12N 9/22* (2006.01)
*C12N 15/11* (2006.01)

(52) U.S. Cl.
CPC ............. *C12N 15/907* (2013.01); *C12N 9/22* (2013.01); *C12N 15/11* (2013.01); *C12N 15/111* (2013.01); *C12N 2310/20* (2017.05); *C12N 2310/315* (2013.01); *C12N 2310/321* (2013.01); *C12N 2310/531* (2013.01); *C12N 2800/80* (2013.01)

(58) Field of Classification Search
None
See application file for complete search history.

(56) References Cited

U.S. PATENT DOCUMENTS

| | | |
|---|---|---|
| 8,383,604 B2 | 2/2013 | Orkin et al. |
| 8,399,645 B2 | 3/2013 | Campana et al. |
| 8,697,359 B1 | 4/2014 | Zhang |
| 8,906,682 B2 | 12/2014 | June et al. |
| 8,956,828 B2 | 2/2015 | Bonini et al. |
| 9,181,527 B2 | 11/2015 | Sentman |
| 9,266,960 B2 | 2/2016 | Morgan et al. |
| 9,272,002 B2 | 3/2016 | Powell, Jr. et al. |
| 9,790,490 B2 | 10/2017 | Zhang et al. |
| 9,890,396 B2 | 2/2018 | Chatterjee et al. |
| 9,896,696 B2 | 2/2018 | Begemann et al. |
| 9,982,278 B2 | 5/2018 | Gill et al. |
| 9,982,279 B1 | 5/2018 | Gill et al. |
| 10,113,167 B2 | 10/2018 | Doudna et al. |
| 10,113,179 B2 | 10/2018 | Begemann et al. |
| 10,253,086 B2 | 4/2019 | Bitter et al. |
| 10,570,418 B2 | 2/2020 | Doudna et al. |
| 10,640,569 B2 | 5/2020 | Beatty et al. |
| 10,767,175 B2 | 9/2020 | Dellinger et al. |
| 10,808,035 B2 | 10/2020 | Chmielewski et al. |
| 10,829,787 B2 | 11/2020 | Yu et al. |
| 10,900,034 B2 | 1/2021 | Ryan et al. |
| 11,118,194 B2 | 9/2021 | Doudna et al. |
| 11,125,739 B2 | 9/2021 | Sharei et al. |
| 2009/0222937 A1 | 9/2009 | Arnould et al. |
| 2009/0271881 A1 | 10/2009 | Arnould et al. |
| 2010/0229252 A1 | 9/2010 | Perez-Michaut |
| 2010/0311124 A1 | 12/2010 | Liu et al. |
| 2011/0016540 A1 | 1/2011 | Weinstein et al. |
| 2011/0023139 A1 | 1/2011 | Weinstein et al. |
| 2011/0023144 A1 | 1/2011 | Weinstein et al. |
| 2011/0023145 A1 | 1/2011 | Weinstein et al. |
| 2011/0023146 A1 | 1/2011 | Weinstein et al. |
| 2011/0023153 A1 | 1/2011 | Weinstein et al. |
| 2011/0091441 A1 | 4/2011 | Gouble et al. |
| 2012/0159653 A1 | 6/2012 | Weinstein et al. |
| 2013/0145487 A1 | 6/2013 | Cedrone |

(Continued)

FOREIGN PATENT DOCUMENTS

| | | |
|---|---|---|
| WO | 2013126794 A1 | 8/2013 |
| WO | 2013142034 A1 | 9/2013 |

(Continued)

OTHER PUBLICATIONS

Zhu et al., "CRISPR-DT: designing gRNAs for the CRISPR-Cpf1 system with iproved target efficiency and specificity" 35(16) Bioinformatics 2783-2789 (Year: 2019).*

(Continued)

*Primary Examiner* — Nancy J Leith

(74) *Attorney, Agent, or Firm* — N.V. Nederlandsch Octrooibureau

(57) ABSTRACT

Provided herein are nucleic acids useful as guide nucleic acids (gNAs), e.g., guide ribonucleic acids (gRNAs), in a CRISPR system wherein the guide nucleic acids contain one or more modifications to one or more nucleotides, use of such guide nucleic acids in modifying cells, and other uses wherein CRISPR Cas proteins are utilized.

19 Claims, 15 Drawing Sheets

Specification includes a Sequence Listing.

(56) References Cited

U.S. PATENT DOCUMENTS

| | | |
|---|---|---|
| 2015/0344912 A1 | 12/2015 | Kim et al. |
| 2018/0028613 A1 | 2/2018 | Suzuki |
| 2018/0119140 A1 | 5/2018 | Porteus et al. |
| 2018/0282763 A1 | 10/2018 | Cigan et al. |
| 2018/0371497 A1 | 12/2018 | Gill et al. |
| 2019/0017050 A1 | 1/2019 | Thanos et al. |

FOREIGN PATENT DOCUMENTS

| | | | |
|---|---|---|---|
| WO | 2013163628 A2 | 10/2013 | |
| WO | 2015048577 A2 | 4/2015 | |
| WO | 2015070083 A1 | 5/2015 | |
| WO | 2015089354 A1 | 6/2015 | |
| WO | 2015120180 A1 | 8/2015 | |
| WO | 2015134812 A1 | 9/2015 | |
| WO | 2015138510 A1 | 9/2015 | |
| WO | 2015148670 A1 | 10/2015 | |
| WO | 2015148860 A1 | 10/2015 | |
| WO | 2015148863 A3 | 10/2015 | |
| WO | 2015153780 A1 | 10/2015 | |
| WO | 2015153789 A1 | 10/2015 | |
| WO | 2015153791 A1 | 10/2015 | |
| WO | 2015188141 A3 | 12/2015 | |
| WO | 2016120220 A1 | 8/2016 | |
| WO | 2016164356 A1 | 10/2016 | |
| WO | 2017017184 A1 | 2/2017 | |
| WO | 2017040945 A1 | 3/2017 | |
| WO | 2017053729 A1 | 3/2017 | |
| WO | 2019126037 A1 | 6/2019 | |
| WO | 2021108324 A1 | 6/2021 | |
| WO | WO 2022/061247 A2 * | 3/2022 | ............... C12N 9/22 |

OTHER PUBLICATIONS

Mcmahon et al., "Chemically Modified Cpf1-CRISPR RNAs Mediate Efficient Genome Editing in Mammalian Cells" 26(5) Molecular Therapy 1228-1240 (Year: 2018).*

International Search Report and Written Opinion for PCT/US2022/017582, dated Jul. 13, 2022, 13 pages.

* cited by examiner

COMPOSITIONS AND METHODS FOR TARGETING, EDITING, OR MODIFYING GENES

CROSS-REFERENCE

This application is a continuation of U.S. patent application Ser. No. 17/958,973 filed Oct. 3, 2022, which is a continuation of PCT/US22/17582 filed Feb. 23, 2022, which claims the benefit of U.S. Provisional Application No. 63/153,847, filed Feb. 25, 2021, and U.S. Provisional Application No. 63/285,851 filed Dec. 3, 2021, which applications are incorporated herein by reference.

SEQUENCE LISTING

The instant application contains a Sequence Listing which has been submitted electronically in .XML format and is hereby incorporated by reference in its entirety. Said. XML copy, created on Jan. 17, 2023, is named ARTN-003CON-T1_ST26.xml and is 2,471,492 bytes in size. The sequence listing contained in this .XML file is part of the specification and is hereby incorporated by reference herein in its entirety.

BACKGROUND OF THE INVENTION

Recent advances have been made in precise genome targeting technologies. For example, specific loci in genomic DNA can be targeted, edited, or otherwise modified by designer meganucleases, zinc finger nucleases, or transcription activator-like effectors (TALEs). Furthermore, the CRISPR-Cas systems of bacterial and archaeal adaptive immunity have been adapted for precise targeting of genomic DNA in eukaryotic cells. Compared to the earlier generations of genome editing tools, the CRISPR-Cas systems are easy to set up, scalable, and amenable to targeting multiple positions within the eukaryotic genome, thereby providing a major resource for new applications in genome engineering. Two distinct classes of CRISPR-Cas systems have been identified. Class 1 CRISPR-Cas systems utilize multi-protein effector complexes, whereas class 2 CRISPR-Cas systems utilize single-protein effectors. Among the three types of class 2 CRISPR-Cas systems, type II and type V systems typically target DNA and type VI systems typically target RNA. Naturally occurring type II effector complexes consist of Cas9, CRISPR RNA (crRNA), and trans-activating CRISPR RNA (tracrRNA), but the crRNA and tracrRNA can be fused as a single guide RNA in an engineered system for simplicity. Certain naturally occurring type V systems, such as type V-A, type V-C, and type V-D systems, do not require tracrRNA and use crRNA alone as the guide for cleavage of target DNA.

The CRISPR-Cas systems have been engineered for various purposes, such as genomic DNA cleavage, base editing, epigenome editing, and genomic imaging. Although significant developments have been made, there still remains a need for new and useful CRISPR-Cas systems as powerful precise genome targeting tools.

SUMMARY OF THE INVENTION

In one aspect, provided herein are compositions.

In certain embodiments, provided herein is a composition comprising a synthetic guide RNA (gRNA) comprising (i) a targeter nucleic acid with a 3' end and a 5' end, comprising: (a) a spacer sequence comprising the 3' end, configured to hybridize with a target nucleotide sequence, and (b) a targeter stem sequence comprising the 5' end; and (ii) a modulator nucleic acid with a 3' end and a 5' end, comprising (a) a modulator stem sequence comprising the 3' end, complementary to the targeter stem sequence, and (b) a 5' sequence, e.g., tail sequence, comprising the 5' end; wherein the targeter nucleic acid and the modulator nucleic acid are separate nucleic acids; and either the targeter nucleic acid or the modulator nucleic acid, or both, is modified at one or more nucleotides or internucleotide linkages at or near its 3' end, at or near its 5' end, or at or near both, and a complex comprising the targeter nucleic acid and the modulator nucleic acid is capable of activating a CRISPR Associated (Cas) nuclease that, in a naturally occurring system, is activated by a single crRNA in the absence of a tracrRNA. In certain embodiments, the modification is a chemical modification. In certain embodiments, the Cas nuclease is a Type V Cas nuclease, such as a type V-A, type V-C, or type V-D Cas nuclease, for example a type V-A Cas nuclease. In certain embodiments the Type V-A Cas nuclease is a Cpf1, MAD, Csm1, ART, or ABW nuclease, or derivative or variant thereof. In certain embodiments the composition further comprises the Cas nuclease that, in a naturally occurring system, is activated by a single crRNA in the absence of a tracrRNA. In certain embodiments the composition further comprises the Cas nuclease. In certain embodiments the targeter nucleic acid, the modulator nucleic acid, and the Cas nuclease are present in a ribonucleoprotein (RNP) complex. In certain embodiments some or all of the nucleic acid is RNA. In certain embodiments the modification, e.g., the chemical modification comprises a chemical modification at or near the 3' end of the targeter nucleic acid. In certain embodiments the chemical modification comprises a chemical modification at a nucleotide or internucleotide linkage within 10 nucleotides of the 3' end. In certain embodiments the chemical modification comprises a chemical modification to the 3' terminal nucleotide or internucleotide linkage. In certain embodiments comprising a modification at or near the 3' end of the targeter nucleic acid the composition further comprises a chemical modification at or near the 5' end of the targeter nucleic acid. In certain embodiments the chemical modifications at or near the 3' and 5' ends are the same. In certain embodiments the chemical modifications at or near the 3' and 5' ends are different. In certain embodiments comprising a modification at or near the 3' and, optionally, at or near the 5' end of the targeter nucleic acid the composition further comprises a chemical modification at or near the 3' end of the modulator nucleic acid. In certain embodiments the chemical modification at or near the 3' end of the modulator nucleic acid is the same as the chemical modification at or near the 3' end of the targeter nucleic acid; different from the chemical modification at or near the 3' end of the targeter nucleic acid; the same as the chemical modification at or near the 5' end of the targeter nucleic acid, if present; different from the chemical modification at or near the 5' end of the targeter nucleic acid, if present; or a combination thereof. In certain embodiments comprising a modification at or near the 3' and, optionally, at or near the 5' end of the targeter nucleic acid and a chemical modification at or near the 3' end of the modulator nucleic acid the composition further comprises a chemical modification at or near the 5' end of the modulator nucleic acid. In certain embodiments the chemical modification at or near the 5' end of the modulator nucleic acid is the same as the chemical modification at or near the 3' end of the targeter nucleic acid; different from the chemical modification at or near the 3' end of the targeter nucleic acid; the same as the chemical modification at or near the 5' end of the targeter nucleic acid, if present; different from the chemical modification at or near the 5' end of the targeter nucleic acid, if present; the same as the chemical modification at or near the 3' end of the modulator nucleic acid, if present; different from the chemical modification at or near the 3' end of the modulator nucleic acid, if present; or a combination thereof. In certain embodiments the chemical modification comprises a chemical modification at or near the 5' end of the targeter nucleic acid. In certain embodiments comprising a modification at or near the 5' end of the targeter nucleic acid the composition further comprises a chemical modification at or near the 3' end of the targeter nucleic acid. In certain embodiments the chemical modifications at or near the 3' and at or near the 5' ends are the same. In certain embodiments the chemical modifications at or near the 3' and at or near the 5' ends are different. In certain embodiments comprising a modification at or near the 5' end of the targeter nucleic acid and, optionally, a chemical modification at or near the 3' end of the targeter nucleic acid, the composition further comprises a chemical modification at or near the 3' end of the modulator nucleic acid. In certain embodiments the chemical modification at or near the 3' end of the modulator nucleic acid is the same as the chemical modification at or near the 5' end of the targeter nucleic acid; different from the chemical modification at or near the 5' end of the targeter nucleic acid; the same as the chemical modification at or near the 3' end of the targeter nucleic acid, if present; different from the chemical modification at or near the 3' end of the targeter nucleic acid, if present; or a combination thereof. In certain embodiments comprising a modification at or near the 5' end of the targeter nucleic acid and, optionally, a chemical modification at or near the 3' end of the targeter nucleic acid and/or a chemical modification at or near the 3' end of the modulator nucleic acid the composition further comprises a chemical modification at or near the 5' end of the modulator nucleic acid. In certain embodiments the chemical modification at or near the 5' end of the modulator nucleic acid is the same as the chemical modification at or near the 5' end of the targeter nucleic acid; different from the chemical modification at or near the 5' end of the targeter nucleic acid; the same as the chemical modification at or near the 3' end of the targeter nucleic acid, if present; different from the chemical modification at or near the 3' end of the targeter nucleic acid, if present; the same as the chemical modification at or near the 3' end of the modulator nucleic acid, if present; different from the chemical modification at or near the 3' end of the modulator nucleic acid, if present; or a combination thereof. In certain embodiments the chemical modification comprises a chemical modification at or near the 3' end of the modulator nucleic acid. In certain embodiments the composition further comprises a chemical modification at or near the 5' end of the modulator nucleic acid. In certain embodiments the chemical modifications at or near the 3' and at or near the 5' ends are the same. In certain embodiments the chemical modifications at or near the 3' and at or near the 5' ends are different. In certain embodiments comprising a modification at or near the 3' end of the modulator nucleic acid and, optionally, a modification at or near the 5' end of the modulator nucleic acid, the composition further comprises a chemical modification at or near the 3' end of the targeter nucleic acid. In certain embodiments the chemical modification at or near the 3' end of the targeter nucleic acid is the same as the chemical modification at or near the 3' end of the modulator nucleic acid; different from the chemical modification at or near the 3' end of the modulator nucleic acid; the same as the chemical modification at or near the 5' end of the modulator nucleic acid, if present; different from the chemical modification at or near the 5' end of the modulator nucleic acid, if present; or a combination thereof. In certain embodiments comprising a modification at or near the 3' end of the modulator nucleic acid and, optionally, a modification at or near the 5' end of the modulator nucleic acid and/or a chemical modification at or near the 3' end of the targeter nucleic acid the composition further comprises a chemical modification at or near the 5' end of the targeter nucleic acid. In certain embodiments the chemical modification at or near the 5' end of the targeter nucleic acid is the same as the chemical modification at or near the 3' end of the modulator nucleic acid; different from the chemical modification at or near the 3' end of the modulator nucleic acid; the same as the chemical modification at or near the 5' end of the modulator nucleic acid, if present; different from the chemical modification at or near the 5' end of the modulator nucleic acid, if present; the same as the chemical modification at or near the 3' end of the targeter nucleic acid, if present; different from the chemical modification at or near the 3' end of the targeter nucleic acid, if present; or a combination thereof. In certain embodiments the chemical modification comprises a chemical modification at or near the 5' end of the modulator nucleic acid. In certain embodiments comprising a chemical modification at or near the 5' end of the modulator nucleic acid the composition further comprises a chemical modification at or near the 3' end of the modulator nucleic acid. In certain embodiments the chemical modifications at or near the 3' and at or near the 5' ends are the same. In certain embodiments the chemical modifications at or near the 3' and at or near the 5' ends are different. In certain embodiments comprising a chemical modification at or near the 5' end of the modulator nucleic acid and, optionally, a chemical modification at or near the 3' end of the modulator nucleic acid, the composition further comprises a chemical modification at or near the 3' end of the targeter nucleic acid. In certain embodiments the chemical modification at or near the 3' end of the targeter nucleic acid is the same as the chemical modification at or near the 5' end of the modulator nucleic acid; different from the chemical modification at or near the 5' end of the modulator nucleic acid; the same as the chemical modification at or near the 3' end of the modulator nucleic acid, if present; different from the chemical modification at or near the 3' end of the modulator nucleic acid, if present; or a combination thereof. In certain embodiments comprising a chemical modification at or near the 5' end of the modulator nucleic acid and, optionally, a chemical modification at or near the 3' end of the modulator nucleic acid and/or a chemical modification at or near the 3' end of the targeter nucleic acid the composition further comprises a chemical modification at or near the 5' end of the targeter nucleic acid. In certain embodiments the chemical modification at or near the 5' end of the targeter nucleic acid is the same as the chemical modification at or near the 5' end of the modulator nucleic acid; different from the chemical modification at or near the 5' end of the modulator nucleic acid; the same as the chemical modification at or near the 3' end of the modulator nucleic acid, if present; different from the chemical modification at or near the 3' end of the modulator nucleic acid, if present; the same as the chemical modification at or near the 3' end of the targeter nucleic acid, if present; different from the chemical modification at or near the 3' end of the targeter nucleic acid, if present; or a combination thereof. In any of the previous embodiments, the chemical modification can be selected from the group consisting of 2'-O-methyl (M), a phosphorothioate(S), a phosphonoacetate (P), a thiophosphonoacetate (SP), a 2'-O-methyl-3'-phosphorothioate (MS), a 2'-O-methyl-3'-phosphonoacetate (MP), a 2'-O-methyl-3'-thiophosphonoacetate (MSP), a 2'-deoxy-3'-phosphonoacetate (DP), a 2'-deoxy-3'-thiophosphonoacetate (DSP), and a combination thereof. In any of the previous embodiments, the spacer sequence can comprise a sequence capable of hybridizing with a human ADORA2A, B2M, CD3E, CD38, CD40LG, CD52, CIITA, CSF2, CTLA4, DCK, FAS, HAVCR2 (also called TIM3), LAG3, PDCD1 (also called PD-1), PTPN6, TIGIT, TRAC, TRBC1, TRBC2, CARD11, CD247, IL7R, LCK, PLCG1, ALPNR, BBS1, CALR, CD3G, CD58, COL17A1, DEFB134, ERAP1, ERAP2, IFNGR1, IFNGR2, JAK1, JAK2, mir-101-2, MLANA, PSMB5, PSMB8, PSMB9, PTCD2, RFX5, RFXANK, RFXAP, RPL23, SOX10, SRP54, STAT1, Tap1, TAP2, TAPBP, TWF1, CD3D, or NLRC5 gene. Any of the previous embodiments may further comprise a Cas protein, for example a Cas nuclease. In certain embodiments, provided is eukaryotic cell comprising the gRNA of any of the previous embodiments, in some cases further comprising a Cas nuclease to which the gRNA binds. In certain embodiments the cell is an immune cell such as a human immune cell. In certain embodiments the immune cell is a T cell. In certain embodiments, the immune cell is a CAR-T cell. In certain embodiments, the gNA-Cas complex is introduced into host cell, e.g., an immune cell, e.g., a T cell, along with an exogenous donor template, e.g., a CAR cassette, where the the exogenous donor template is introduced into the genome of the host cell through the activity of the gNA-Cas complex resulting in a modified cell, e.g., a CAR-T cell. In certain embodiments provided herein is a composition comprising any of the preceding composition and further comprising a Cas protein. In certain embodiments the Cas protein comprises a Cas nuclease. In certain embodiments the Cas nuclease is a Type I, II, III, IV, V, or VI Cas nuclease. In certain embodiments the Cas nuclease is a Type V Cas nuclease. In certain embodiments the Cas nuclease is a Type V-A, V-C, or V-D nuclease. In certain embodiments the Cas nuclease is a Type V-A Cas nuclease. In certain embodiments the Type V-A Cas nuclease is a Cpf1, MAD, Csm1, ART, or ABW Cas nuclease, or a derivative or variant thereof. In certain embodiments provided herein is a pharmaceutical composition comprising any of the preceding compositions and a pharmaceutically acceptable carrier.

In one aspect, provided herein are methods.

In certain embodiments, provided herein is method of cleaving a target DNA having a target nucleotide sequence, the method comprising contacting the target DNA with a composition of the preceding paragraph, thereby resulting in cleavage of the target DNA. In certain embodiments the contacting occurs in vitro. In certain embodiments the contacting occurs in a cell ex vivo. In certain embodiments the target DNA is genomic DNA of the cell. In certain embodiments the system is delivered into the cell as a pre-formed RNP complex. In certain embodiments the pre-formed RNP complex is delivered into the cell by electroporation, lipofection, or a viral method. In certain embodiments the pre-formed RNP complex is delivered into the cell by electroporation.

In certain embodiments provided herein is a method of editing the genome of a eukaryotic cell, the method comprising delivering the engineered, non-naturally occurring system of any of the embodiments of the first paragraph of this section, thereby resulting in editing of the genome of the eukaryotic cell. In certain embodiments the system is delivered into the cell as a pre-formed RNP complex. In certain embodiments the system is delivered into the cell by electroporation, lipofection, or a viral method. In certain embodiments the system is delivered into the cell by electroporation. In certain embodiments the cell is an immune cell. In certain embodiments the immune cell is a T lymphocyte. In certain embodiments the engineered, non-naturally occurring system is delivered to a plurality of eukaryotic cells, and wherein the system comprises a guide nucleic acid comprising one or modifications as described herein, wherein the editing efficiency of the genomes of the plurality of cells is increased by at least 5% compared to the editing efficiency when the same system but without the modification or modifications is used.

In certain embodiments, provided herein is a method of treating a disease or a disorder comprising administering to a subject in need thereof an effective amount of a composition of the first paragraph of this section. In certain embodiments the method comprises administering to a subject in need thereof of cells modified by treatment with a composition of the first paragraph of this section. In certain embodiments the cells are cells that are removed from an individual and treated ex vivo. In certain embodiments the subject in need of treatment and the individual whose cells are treated ex vivo are the same.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

DETAILED DESCRIPTION OF THE INVENTION

Figure 1A:
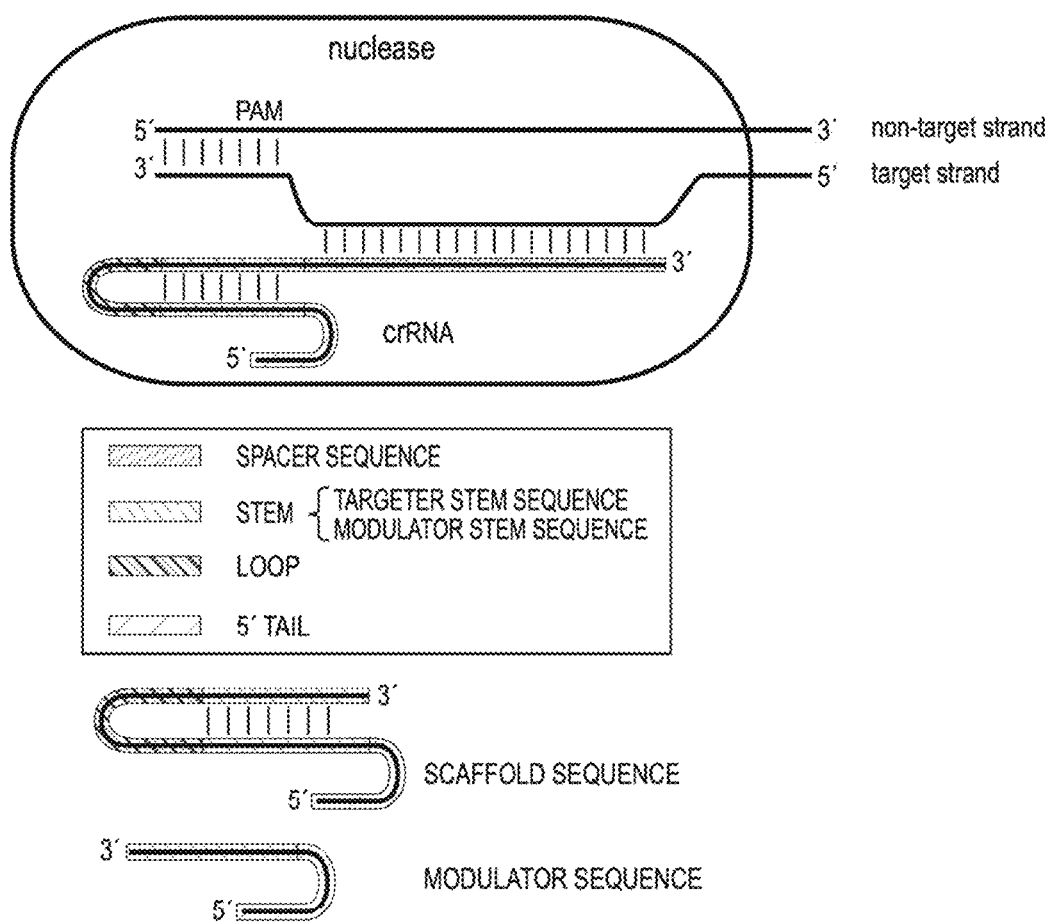
FIG. 1A shows a schematic representation showing the structure of an exemplary dual single guide CRISPR-Cas system.

I. Engineered, non-naturally occurring modified guide, e.g., dual guide CRISPR-Cas Systems
   A. Nucleic Acid Modifications to Guide Nucleic Acids
      1. Specific Modifications to Targeter and/or Modulator Nucleic Acids
   B. Targeter and Modulator Nucleic Acids
   C. Cas Proteins
II. Methods of Targeting, Editing, and/or Modifying Genomic DNA
   A. Ribonucleoprotein (RNP) Delivery and "Cas RNA" Delivery
   B. CRISPR Expression Systems
   C. Donor Templates
   D. Efficiency and Specificity
   E. Multiplex Methods
III. Pharmaceutical Compositions
IV. Therapeutic Uses
   A. Gene Therapies
   B. Immune Cell Engineering
V. Kits
VI. Embodiments
VII. Examples The invention is based, in part, upon the design of a modified guide CRISPR-Cas system, such as a modified dual guide CRISPR-Cas system in which a targeter nucleic acid and a modulator nucleic acid, when hybridized to form a complex, can, e.g., activate a Cas nuclease that, in a naturally occurring system, is activated by a single crRNA in the absence of a tracrRNA. The engineered modified dual guide CRISPR-Cas systems described herein can be used to target, edit, or modify a target nucleic acid such as genomic DNA. Modifications include a chemical modification to one or more nucleotides or internucleotide linkages at or near the 3' end of the targeter nucleic acid, at or near the 5' end of the targeter nucleic acid (if a dual guide system), at or near the 3' end of the modulator nucleic acid (if a dual guide system), at or near the 5' end of the modulator nucleic acid, or combinations thereof. In cases where more than one locus is modified, the chemical modification at each locus can be the same or different. In certain embodiments the modified guide nucleic acid (gNA) can be a single guide nucleic acid such as a single guide RNA, wherein the targeter and modulator nucleic acid are joined by a plurality of nucleotides; while embodiments are described in terms of dual guide nucleic acids it is understood that the same can be applied to single guide nucleic acids, where appropriate.

A CRISPR-Cas system generally comprises a Cas protein and one or more guide nucleic acids, e.g., gRNAs. The Cas protein can be directed to a specific location in a double-stranded DNA target by recognizing a protospacer adjacent motif (PAM) in the non-target strand of the DNA, and the one or more guide nucleic acids can be directed to a specific location by hybridizing with a target nucleotide sequence in the target strand of the DNA. Both PAM recognition and target nucleotide sequence hybridization are required for stable binding of a CRISPR-Cas complex to the DNA target and, if the Cas protein has an effector function, e.g., nuclease activity, activation of the effector function. As a result, when creating a CRISPR-Cas system, a guide nucleic acid can be designed to comprise a nucleotide sequence called spacer sequence that hybridizes with a target nucleotide sequence, where target nucleotide sequence is located adjacent to a PAM in an orientation operable with the Cas protein. It has been observed that not all CRISPR-Cas systems designed by these criteria are equally effective.

Type V-A, type V-C, and type V-D CRISPR-Cas systems naturally include a Cas nuclease and a single guide RNA (i.e., crRNA) while lacking a tracrRNA. By splitting the single guide RNA into two different nucleic acids, where at least one end of one of the nucleic acids is chemically modified, the engineered system describe herein provides better flexibility and tunability. For example, the efficiency of nucleic acid cleavage can be increased or decreased by adjusting the hybridization length and/or affinity of the targeter nucleic acid and the modulator nucleic acid. Furthermore, given the length limitation of nucleic acids that can be synthesized with high yield and accuracy, the use of modified dual guide nucleic acids allows incorporation of more polynucleotide elements that can improve editing efficacy and/or specificity.

In particular, the modified dual guide system can be engineered as a tunable system to decrease off-target editing, and thus can be used to edit a nucleic acid with high specificity. The system can be employed in a number of applications, for example, editing cells such as mammalian cells for use in therapy. A decrease in off-target editing is particularly desirable when creating genetically engineered proliferating cells, such as stem cells, progenitor cells, and immune memory cells, to be administered to a subject in need of the therapy. High specificity can be accomplished using the modified dual guide systems described herein, which optionally further include, for example, one or more chemical modifications to the targeter nucleic acid and/or modulator nucleic acid, an editing enhancer sequence, and/or a donor template-recruiting sequence. The nature and/or location of the chemical modifications can modulate editing efficiency in the CRISPR system. For example, in certain embodiments a modification at or near the 5' end, at or near the 3' end, and/or at or near both of a targeter and/or modulator nucleic acid, e.g., one or more modifications to one or more nucleotides, as described elsewhere herein, can result in at least a 1, 2, 5, 10, 15, 20, 30, 40, 50, 60, 70, 80, or 90% increase in editing efficiency; in some cases a similar decrease in editing efficiency may be achieved, compared to non-modulated nucleic acids.

Figure 1B:
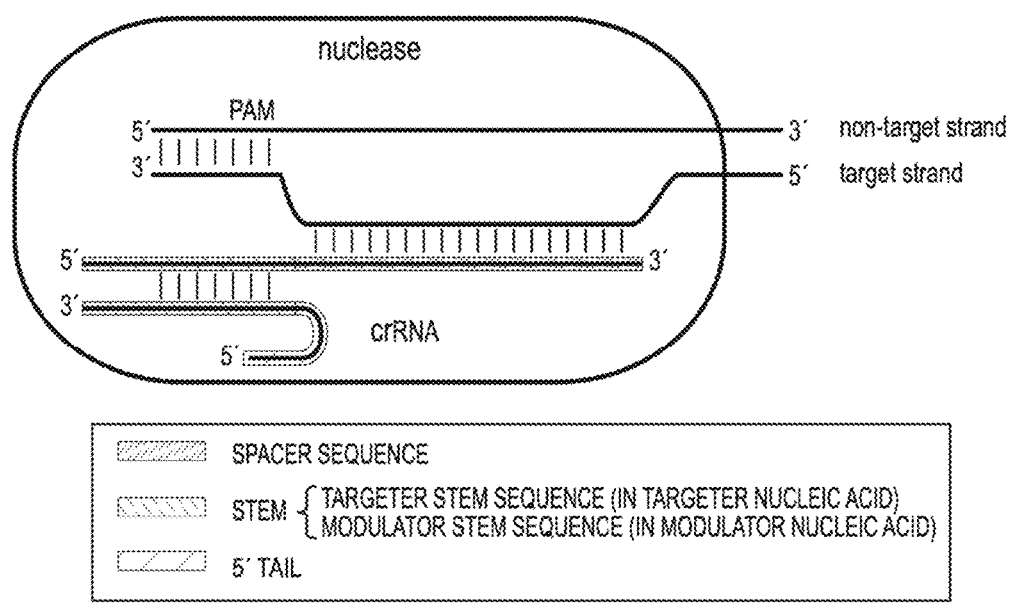
FIG. 1B shows a schematic representation showing the structure of an exemplary dual guide CRISPR-Cas system.

Thus, provided herein are guide nucleic acids, such as RNAs, comprising a targeter nucleic acid and a modulator nucleic acid; see, e.g., FIG. 1A, showing a single guide nucleic acid, and FIG. 1B, showing a dual guide nucleic acid. One or more nucleotides or internucleotide linkages at or near the 5' end (of the modulator nucleic acid in a sgNA, of either or both of modulator nucleic acid and/or targeter nucleic acid in dual gNA), at or near the 3' end (of the targeter nucleic acid in a sgNA, of either or both of modulator nucleic acid and/or targeter nucleic acid in dual gNA), or both of the targeter and/or modulator nucleic acids comprise one or more modified nucleotides or internucleotide linkages, e.g., chemically modified nucleotides. Specific embodiments are as described herein, and include embodiments in which a specific gene is targeted by the modified guide nucleic acid, e.g., modified single guide nucleic acid such as modified single guide RNA, or modified dual guide nucleic acid such as a modified dual guide RNA. In certain embodiments, provided are compositions comprising a modified guide nucleic acid as described herein and a Cas protein, such as a Cas nuclease. The protein, e.g., nuclease can be any suitable protein, e.g., nuclease; in certain embodiments, the nuclease is a Type I, II, III, IV, V, or VI Cas nuclease; in certain embodiments the nuclease is Type V Cas nuclease, such as a Type V-A, V-C, or V-D nuclease, for example, a Type V-A nuclease. Specific nucleases are as described herein. In certain embodiments, the composition can also comprise a donor template. In certain embodiments, provided are CRISPR expression systems for expressing one or more of the nuclease, the targeter nucleic acid, the modulator nucleic acid, and/or, optionally, a donor template; it will be appreciated that, in general, the modified nucleic acids cannot be expressed by such a system. Also provided are cells, such as an immune cell, e.g., a T cell, comprising one or more of the modified guide nucleic acids described herein, Cas nucleases as described herein, and/or donor template. In certain embodiments, provided are pharmaceutical compositions comprising compositions comprising modified guide nucleic acids, as described herein. In certain embodiments, provided are methods for targeting, editing, and/or modifying genomic DNA using the modified guide nucleic acid compositions described herein. In certain embodiments, provided herein are methods of gene therapy utilizing the modified guide nucleic acid compositions described herein. In certain embodiments, provided herein are methods of immune cell engineering utilizing the modified guide nucleic acid compositions described herein. In certain embodiments, provided are kits comprising the modified guide nucleic acids described herein.

The features and uses of the modified single and dual guide CRISPR-Cas system are discussed in detail in the following sections.

I. ENGINEERED, NON-NATURALLY OCCURRING MODIFIED GUIDE NUCLEIC ACID-CRISPR-CAS SYSTEMS

In certain embodiments, the engineered, non-naturally occurring system of the present invention comprises a targeter nucleic acid comprising a spacer sequence designed to hybridize with a target nucleotide sequence and a targeter stem sequence; and a modulator nucleic acid comprising a modulator stem sequence complementary to the targeter stem sequence and, optionally, a 5' sequence, e.g., a tail sequence, wherein, in the case of a single guide nucleic acid the guide nucleic acid is a single polynucleotide, and in the case of a dual guide nucleic acid, the targeter nucleic acid and the modulator nucleic acid are separate nucleic acids, and wherein a guide nucleic acid comprising the targeter nucleic acid and the modulator nucleic acid is capable of activating a Cas nuclease; in certain cases of dual gNAs, the nuclease is one that, in a naturally occurring system, is activated by a single crRNA in the absence of a tracrRNA. See FIGS. 1A and 1B. One or both of the targeter nucleic acid and/or the modulator nucleic acid includes one or more modified nucleotides or internucleotide linkages at or near the 3' end, at or near the 5' end, or at or near both.

The terms "targeter stem sequence" and "modulator stem sequence," as used herein, can include a pair of nucleotide sequences in one or more guide nucleic acids that hybridize with each other. When a targeter stem sequence and a modulator stem sequence are contained in a single guide nucleic acid, the targeter stem sequence is proximal to a spacer sequence designed to hybridize with a target nucleotide sequence, and the modulator stem sequence is proximal to the targeter stem sequence. When a targeter stem sequence and a modulator stem sequence are in separate nucleic acids, i.e. in a dual guide nucleic acid, the targeter stem sequence is in the same nucleic acid as a spacer sequence designed to hybridize with a target nucleotide sequence. In a CRISPR-Cas system that naturally includes separate crRNA and tracrRNA (e.g., a type II system), the duplex formed between the targeter stem sequence and the modulator stem sequence corresponds to the duplex formed between the crRNA and the tracrRNA. In a CRISPR-Cas system that naturally includes a single crRNA but no tracrRNA (e.g., a type V-A system), the duplex formed between the targeter stem sequence and the modulator stem sequence corresponds to the stem portion of a stem-loop structure in the scaffold sequence (also called direct repeat sequence) of the crRNA. It is understood that 100% complementarity is not required between the targeter stem sequence and the modulator stem sequence. In a type V-A CRISPR-Cas system, however, the targeter stem sequence is typically 100% complementary to the modulator stem sequence.

In certain embodiments wherein the target nucleic acid and the modulator nucleic acid comprise a single polynucleotide, a loop motif may exist between the 3' stem sequence of the targeter nucleic acid and the 5' stem sequence of the modulator nucleic acid, e.g., a stem loop. In certain embodiments, the loop motif is between 1-11, 2-11, 3-11, 4-11, 5-11, 3-10, 3-9, 3-8, 3-7, 3-6, 1-11, 2-10, 3-9, 4-8, 5-7, 4-6, 1-7, 2-6, 3-5 nucleotides in length. In a preferred embodiment, the loop motif is between 3-5 nucleotides in length. In a separate preferred embodiment, the loop motif is four nucleotides in length. In certain embodiments, the loop motif is 5'-TCTT-3' or 5'-TATT-3'.

The term "targeter nucleic acid," as used herein in the context of a dual guide nucleic acid CRISPR-Cas system, can include a nucleic acid comprising (i) a spacer sequence designed to hybridize with a target nucleotide sequence; and (ii) a targeter stem sequence capable of hybridizing with an additional nucleic acid to form a complex, wherein the complex is capable of activating a Cas nuclease (e.g., a type II or type V-A Cas nuclease) under suitable conditions, and wherein the targeter nucleic acid alone, in the absence of the additional nucleic acid, is not capable of activating the Cas nuclease under the same conditions. The term "targeter nucleic acid," as used herein in the context of a single guide nucleic acid CRISPR-Cas system, can include a nucleic acid comprising (i) a spacer sequence designed to hybridize with a target nucleotide sequence; and (ii) a targeter stem sequence capable of hybridizing with a complementary stem sequence in a modulator nucleic acid that is 5' to the targeter nucleic acid in the single polyucleotide of the sgNA, wherein the sgNA is capable of activating a Cas nuclease (e.g., a type II or type V-A Cas nuclease).

The term "modulator nucleic acid," as used herein in connection with a given targeter nucleic acid and its corresponding Cas nuclease, can include a nucleic acid capable of hybridizing with the targeter nucleic acid, to form an intrapolynucleotide hybridized portion in the case of a sgNA, and to form a complex in the case of a dual gNA, wherein the sgNA or complex, but not the modulator nucleic acid alone, is capable of activating the type Cas nuclease under suitable conditions.

The term "suitable conditions," as used in connection with the definitions of "targeter nucleic acid" and "modulator nucleic acid," can include the conditions under which a naturally occurring CRISPR-Cas system is operative, such as in a prokaryotic cell, in a eukaryotic (e.g., mammalian or human) cell, or in an in vitro assay.

Type V-A, type V-C, and type V-D CRISPR-Cas systems are distinctive subtypes of CRISPR-Cas systems under the classification described in Makarova et al. (2017) CELL, 168:328. Naturally occurring CRISPR-Cas systems of these subtypes lack a tracrRNA and rely on a single crRNA to guide the CRISPR-Cas complex to the target DNA. Naturally occurring type V-A Cas proteins comprise a RuvC-like nuclease domain but lack an HNH endonuclease domain, and recognize a 5' T-rich protospacer adjacent motif (PAM), the 5' orientation determined using the non-target strand (i.e. the strand not hybridized with the spacer sequence) as the coordinate.

Naturally occurring type V-A CRISPR-Cas systems cleave a double-stranded DNA to generate a staggered double-stranded break rather than a blunt end. The cleavage site is distant from the PAM site (e.g., separated by at least 10, 11, 12, 13, 14, or 15 nucleotides from the PAM on the non-target strand and/or separated by at least 15, 16, 17, 18, or 19 nucleotides from the sequence complementary to PAM on the target strand).

The instant disclosure provides an engineered, non-naturally occurring system comprising a targeter nucleic acid comprising: a spacer sequence designed to hybridize with a target nucleotide sequence; and a targeter stem sequence; and a modulator nucleic acid comprising a modulator stem sequence complementary to the targeter stem sequence, and, optionally, a 5' sequence, e.g., a tail sequence, wherein, in the case of a single guide nucleic acid the targeter nucleic acid and the modulator nucleic acid are part of a single polynucleotide, and in the case of a dual guide nucleic acid, the targeter nucleic acid and the modulator nucleic acid are separate nucleic acids; modifications can include one or more chemical modifications to one or more nucleotides at or near the 3' end of the targeter nucleic acid (dual and single gNA), at or near the 5' end of the targeter nucleic acid (dual gNA), at or near the 3' end of the modulator nucleic acid (dual gNA), at or near the 5' end of the modulator nucleic acid (single and dual gNA), or combinations thereof, and wherein the gNA comprising the targeter nucleic acid and the modulator nucleic acid is capable of activating a Cas nuclease, such as a Type I, II, III, IV, V, or VI Cas nuclease, such as a Type V Cas nuclease, for example, a type V-A, type V-C, or type V-D Cas nuclease. In certain embodiments, the Cas nuclease is a type V-A Cas nuclease. In certain embodiments the targeter sequence comprises, from 5' to 3', a targeter stem sequence and a spacer sequence and the modulator sequence comprises, from 5' to 3', a 5' sequence, e.g., a tail sequence, and a modulator stem sequence. In certain embodiments, the system also comprises a Cas nuclease, such as type V-A, type V-C, or type V-D Cas nuclease, for example, a Type V-A Cas nuclease.

A. Nucleic Acid Modifications in Guide Nucleic Acids

Provided herein are engineered, non-naturally occurring systems comprising a targeter nucleic acid comprising: a spacer sequence designed to hybridize with a target nucleotide sequence and a targeter stem sequence; and a modulator nucleic acid comprising a modulator stem sequence complementary to the targeter stem sequence, and, optionally, a 5' sequence, e.g., a tail sequence, wherein, in a single guide nucleic acid the targeter nucleic acid and the modulator nucleic acid are part of a single polynucleotide, and in a dual guide nucleic acid, the targeter nucleic acid and the modulator nucleic acid are separate nucleic acids; modifications can include one or more chemical modifications to one or more nucleotides or internucleotide linkages at or near the 3' end of the targeter nucleic acid (dual and single gNA), at or near the 5' end of the targeter nucleic acid (dual gNA), at or near the 3' end of the modulator nucleic acid (dual gNA), at or near the 5' end of the modulator nucleic acid (single and dual gNA), or combinations thereof as appropriate for single or dual gNA. In certain embodiments, the Cas nuclease is a type V-A Cas nuclease. Modulator and/or targeter nucleic sequences can include further sequences, as detailed in Section IB, and modifications can be in these further sequences, as appropriate and apparent to one of skill in the art. In embodiments described in this section, below, in certain embodiments, guide nucleic acid is oriented from 5' at the modulator nucleic acid to 3' at the modulator stem sequence, and 5' at the targeter stem sequence to 3' at the targeter sequence (see, e.g., FIGS. 1A and 1B); in certain embodiments, as appropriate, guide nucleic acid is oriented from 3' at the modulator nucleic acid to 5' at the modulator stem sequence, and 3' at the targeter stem sequence to 5' at the targeter sequence.

The targeter nucleic acid may comprise a DNA (e.g., modified DNA), an RNA (e.g., modified RNA), or a combination thereof. The modulator nucleic acid may comprise a DNA (e.g., modified DNA), an RNA (e.g., modified RNA), or a combination thereof. In certain embodiments, the targeter nucleic acid is an RNA and the modulator nucleic acid is an RNA. A targeter nucleic acid in the form of an RNA is also called targeter RNA, and a modulator nucleic acid in the form of an RNA is also called modulator RNA. The nucleotide sequences disclosed herein are presented as DNA sequences by including thymidines (T) and/or RNA sequences including uridines (U). It is understood that corresponding DNA sequences, RNA sequences, and DNA/RNA chimeric sequences are also contemplated. For example, where a spacer sequence is presented as a DNA sequence, a nucleic acid comprising this spacer sequence as an RNA can be derived from the DNA sequence disclosed herein by replacing each T with U. As a result, for the purpose of describing a nucleotide sequence, T and U are used interchangeably herein.

In certain embodiments some or all of the gNA is RNA, e.g., a gRNA. In certain embodiments, 5-100%, 10-100%, 20-100%, 30-100%, 40-100%, 50-100%, 60-100%, 70-100%, 80-100%, 90-100%, 95-100%, 99-100%, 99.5-100% of the gNA is gRNA. In certain embodiments, 20%-80%, 20%-70%, 20%-60%, 20%-50%, 20%-40%, 20%-30%, 30%-80%, 30%-70%, 30%-60%, 30%-50%, 30%-40%, 40%-80%, 40%-70%, 40%-60%, 40%-50%, 50%-80%, 50%-70%, 50%-60%, 60%-80%, 60%-70%, or 70%-80% of gNA is RNA. In certain embodiments, 50% of the gNA is RNA. In certain embodiments, 70% of the gNA is RNA. In certain embodiments, 90% of the gNA is RNA. In certain embodiments, 100% of the gNA is RNA, e.g., a gRNA.

In certain embodiments the stem sequences are 1-20, 2-19, 3-18, 4-17, 5-16, 6,-15, 7-14, 8-13, 9-12, 10-11, 1-9, 2-8, 3-7, 4-6, or 2-9 nucleotides in length. In a preferred embodiment, the stem sequences are 4-6 nucleotides in length. In certain embodiments, the stem sequence of the modulator and targeter nucleic acids share 5%-100%, 10%-100%, 20%-100%, 30%-100%, 40%-100%, 50%-100%, 60%-100%, 70%-100%, 80%-100%, 90%-100%, 95%-100%, 99%-100%, 99.5%-100% of the gNA is gRNA. In certain embodiments, 20%-80%, 20%-70%, 20%-60%, 20%-50%, 20%-40%, 20%-30%, 30%-80%, 30%-70%, 30%-60%, 30%-50%, 30%-40%, 40%-80%, 40%-70%, 40%-60%, 40%-50%, 50%-80%, 50%-70%, 50%-60%, 60%-80%, 60%-70%, or 70%-80% sequence complementarity. In certain embodiments, the stem sequence of the modulator and targeter nucleic acids share 80%, 90%, 95%, or 100% sequence complementarity. In a preferred embodiment, the stem sequence of the modulator and targeter nucleic acids share 80%-100% sequence complementarity.

In certain embodiments, the targeter nucleic acid and/or the modulator nucleic acid are RNAs with one or more modifications in a ribose group, one or more modifications in a phosphate group, one or more modifications in a nucleobase, one or more terminal modifications, or a combination thereof. Exemplary modifications are disclosed in U.S. Pat. Nos. 10,900,034 and 10,767,175, U.S. Patent Application Publication No. 2018/0119140, Watts et al. (2008) Drug Discov. Today 13:842-55, and Hendel et al. (2015) NAT. BIOTECHNOL. 33:985.

Modifications in a ribose group include but are not limited to modifications at the 2' position or modifications at the 4' position. For example, in certain embodiments, the ribose comprises 2'-O—C1-4alkyl, such as 2'-O-methyl (2'-OMe, or M). In certain embodiments, the ribose comprises 2'-O—C1-3alkyl-O-C1-3alkyl, such as 2'-methoxyethoxy (2'-O—CH$_2$CH$_2$OCH$_3$) also known as 2'-O-(2-methoxyethyl) or 2'-MOE. In certain embodiments, the ribose comprises 2'-O-allyl. In certain embodiments, the ribose comprises 2'-O-2,4-Dinitrophenol (DNP). In certain embodiments, the ribose comprises 2'-halo, such as 2'-F, 2'-Br, 2'-Cl, or 2'-I. In certain embodiments, the ribose comprises 2'-NH$_2$. In certain embodiments, the ribose comprises 2'-H (e.g., a deoxynucleotide). In certain embodiments, the ribose comprises 2'-arabino or 2'-F-arabino. In certain embodiments, the ribose comprises 2'-LNA or 2'-ULNA. In certain embodiments, the ribose comprises a 4'-thioribosyl.

Modifications can also include a deoxy group, for example a 2'-deoxy-3'-phosphonoacetate (DP), a 2'-deoxy-3'-thiophosphonoacetate (DSP).

Internucleotide linkage modifications in a phosphate group include but are not limited to a phosphorothioate(S), a chiral phosphorothioate, a phosphorodithioate, a boranophosphonate, a C$_{1-4}$alkyl phosphonate such as a methylphosphonate, a boranophosphonate, a phosphonocarboxylate such as a phosphonoacetate (P), a phosphonocarboxylate ester such as a phosphonoacetate ester, an amide, a thiophosphonocarboxylate such as a thiophosphonoacetate (SP), a thiophosphonocarboxylate ester such as a thiophosphonoacetate ester, and a 2',5'-linkage having a phosphodiester or any of the modified phosphates above. Various salts, mixed salts and free acid forms are also included.

Modifications in a nucleobase include but are not limited to 2-thiouracil, 2-thiocytosine, 4-thiouracil, 6-thioguanine, 2-aminoadenine, 2-aminopurine, pseudouracil, hypoxanthine, 7-deazaguanine, 7-deaza-8-azaguanine, 7-deazaadenine, 7-deaza-8-azaadenine, 5-methylcytosine, 5-methyluracil, 5-hydroxymethylcytosine, 5-hydroxymethyluracil, 5,6-dehydrouracil, 5-propynylcytosine, 5-propynyluracil, 5-ethynylcytosine, 5-ethynyluracil, 5-allyluracil, 5-allylcytosine, 5-aminoallyluracil, 5-aminoallyl-cytosine, 5-bromouracil, 5-iodouracil, diaminopurine, difluorotoluene, dihydrouracil, an abasic nucleotide, Z base, P base, Unstructured Nucleic Acid, isoguanine, isocytosine (see, Piccirilli et al. (1990) NATURE, 343:33), 5-methyl-2-pyrimidine (see, Rappaport (1993) BIOCHEMISTRY, 32:3047), x (A,G,C,T), and y (A,G,C,T).

Terminal modifications include but are not limited to polyethyleneglycol (PEG), hydrocarbon linkers (such as heteroatom (O,S,N)-substituted hydrocarbon spacers; halo-substituted hydrocarbon spacers; keto-, carboxyl-, amido-, thionyl-, carbamoyl-, thionocarbamaoyl-containing hydrocarbon spacers, propanediol), spermine linkers, dyes such as fluorescent dyes (for example, fluoresceins, rhodamines, cyanines), quenchers (for example, dabcyl, BHQ), and other labels (for example biotin, digoxigenin, acridine, streptavidin, avidin, peptides and/or proteins). In certain embodiments, a terminal modification comprises a conjugation (or ligation) of the RNA to another molecule comprising an oligonucleotide (such as deoxyribonucleotides and/or ribonucleotides), a peptide, a protein, a sugar, an oligosaccharide, a steroid, a lipid, a folic acid, a vitamin and/or other molecule. In certain embodiments, a terminal modification incorporated into the RNA is located internally in the RNA sequence via a linker such as 2-(4-butylamidofluorescein) propane-1,3-diol bis (phosphodiester) linker, which is incorporated as a phosphodiester linkage and can be incorporated anywhere between two nucleotides in the RNA.

The modifications disclosed above can be combined in the targeter nucleic acid and/or the modulator nucleic acid that are in the form of RNA. In certain embodiments, the modification in the RNA is selected from the group consisting of incorporation of 2'-O-methyl-3'phosphorothioate (MS), 2'-O-methyl-3'-phosphonoacetate (MP), 2'-O-methyl-3'-thiophosphonoacetate (MSP), 2'-halo-3'-phosphorothioate (e.g., 2'-fluoro-3'-phosphorothioate), 2'-halo-3'-phosphonoacetate (e.g., 2'-fluoro-3'-phosphonoacetate), and 2'-halo-3'-thiophosphonoacetate (e.g., 2'-fluoro-3'-thiophosphonoacetate).

In certain embodiments, modifications can include 2'-O-methyl (M), a phosphorothioate(S), a phosphonoacetate (P), a thiophosphonoacetate (SP), a 2'-O-methyl-3'-phosphorothioate (MS), a 2'-O-methyl-3'-phosphonoacetate (MP), a 2'-O-methyl-3'-thiophosphonoacetate (MSP), a 2'-deoxy-3'-phosphonoacetate (DP), a 2'-deoxy-3'-thiophosphonoacetate (DSP), or a combination thereof, at or near either the 3' or 5' end of either the targeter or modulator nucleic acid, as appropriate for single or dual gNA.

In certain embodiments, modifications can include either a 5' or a 3' propanediol or C3 linker modification as depicted in FIG. 7A or B respectively.

In certain embodiments, the modification alters the stability of the RNA. In certain embodiments, the modification enhances the stability of the RNA, e.g., by increasing nuclease resistance of the RNA relative to a corresponding RNA without the modification. Stability-enhancing modifications include but are not limited to incorporation of 2'-O-methyl, a 2'-O—C1-4alkyl, 2'-halo (e.g., 2'-F, 2'-Br, 2'-Cl, or 2'-I), 2'MOE, a 2'-O—C1-3alkyl-O-C1-3alkyl, 2'-NH$_2$, 2'-H (or 2'-deoxy), 2'-arabino, 2'-F-arabino, 4'-thio-ribosyl sugar moiety, 3'-phosphorothioate, 3'-phosphonoacetate, 3'-thiophosphonoacetate, 3'-methylphosphonate, 3'-boranophosphate, 3'-phosphorodithioate, locked nucleic acid ("LNA") nucleotide which comprises a methylene bridge between the 2' and 4' carbons of the ribose ring, and unlocked nucleic acid ("ULNA") nucleotide. Such modifications are suitable for use as a protecting group to prevent or reduce degradation of the 5' sequence, e.g., a tail sequence, modulator stem sequence (dual guide nucleic acids), targeter stem sequence (dual guide nucleic acids), and/or spacer sequence (see, the "Targeter and Modulator nucleic acids" subsection).

1. Specific Modifications to Targeter and/or Modulator Nucleic Acids

In certain embodiments, a targeter nucleic acid, e.g., RNA, comprises at least one nucleotide at or near the 3' end comprising a modification to a ribose, phosphate group, nucleobase, or terminal modification. In certain embodiments, the 3' end of the targeter nucleic acid comprises the spacer sequence. In certain embodiments, the 3' end of the targeter nucleic acid comprises the targeter stem sequence. Exemplary modifications are disclosed in Dang et al. (2015) Genome Biol. 16:280, Kocaz et al. (2019) Nature Biotech. 37:657-66, Liu et al. (2019) Nucleic Acids Res. 47 (8): 4169-4180, Schubert et al. (2018) J. Cytokine Biol. 3 (1): 121, Teng et al. (2019) Genome Biol. 20 (1): 15, Watts et al. (2008) Drug Discov. Today 13 (19-20): 842-55, and Wu et al. (2018) Cell Mol. Life. Sci. 75 (19): 3593-607.

In certain embodiments, one or more nucleotides or internucleotide linkages within 15, 10, 5, 4, 3, 2, or 1 nucleotides of the 3' end of the targeter nucleic acid is modified. In certain embodiments, the nucleotide or internucleotide linkage at or near the 3' end of the targeter nucleic acid is modified. In certain embodiments, 2, 3, 4, 5, 6, 7, 8, 9, or 10 nucleotides or internucleotide linkages within 15, 10, 5, 4, 3, or 2, or nucleotides of the 3' end of the targeter nucleic acid (as appropriate for total number of nucleotides or internucleotide linkages modified) of the targeter nucleic acid are modified, wherein the modified nucleotides or internucleotide linkages can have the same modification, different modification, or any combination thereof. In certain embodiments, modifications can include 2'-O-methyl (M), a phosphorothioate(S), a phosphonoacetate (P), a thiophosphonoacetate (SP), a 2'-O-methyl-3'-phosphorothioate (MS), a 2'-O-methyl-3'-phosphonoacetate (MP), a 2'-O-methyl-3'-thiophosphonoacetate (MSP), a 2'-deoxy-3'-phosphonoacetate (DP), a 2'-deoxy-3'-thiophosphonoacetate (DSP), or a combination thereof, at or near the 3' end of the targeter nucleic acid. In certain embodiments, a nucleotide at or near the 3' end of the targeter nucleic acid, for example within 10, 5, 4, 3, 2, or 1 nucleotides of the 3' end, for example the 3' end nucleotide, comprises a 2'-O-methyl (M). In certain embodiments, an internucleotide linkage at or near the 3' end of the targeter sequence, for example within 10, 5, 4, 3, 2, or 1 internucleotide linkage of the 3' end, for example the 3' end internucleotide linkage, comprises a phosphorothioate(S). In certain embodiments, an internucleotide linkage at or near the 3' end of the targeter nucleic acid, for example within 10, 5, 4, 3, 2, or 1 internucleotide linkage of the 3' end, for example the 3' end internucleotide linkage, comprises a phosphonoacetate (P). In certain embodiments, an internucleotide linkage at or near the 3' end of the targeter nucleic acid, for example within 10, 5, 4, 3, 2, or 1 internucleotide linkage of the 3' end, for example the 3' end internucleotide linkage, comprises a thiophosphonoacetate (SP). In certain embodiments, a nucleotide at or near the 3' end of the targeter nucleic acid, for example within 10, 5, 4, 3, 2, or 1 nucleotide of the 3' end, for example the 3' end nucleotide, comprises a 2'-O-methyl-3'-phosphorothioate (MS). In certain embodiments, a nucleotide at or near the 3' end of the targeter nucleic acid, for example within 10, 5, 4, 3, 2, or 1 nucleotide of the 3' end, for example the 3' end nucleotide, comprises a 2'-O-methyl-3'-phosphonoacetate (MP). In certain embodiments, a nucleotide at or near the 3' end of the targeter nucleic acid, for example within 10, 5, 4, 3, 2, or 1 nucleotide of the 3' end, for example the 3' end nucleotide, comprises a 2'-O-methyl-3'-thiophosphonoacetate (MSP). In certain embodiments, a nucleotide at or near the 3' end of the targeter nucleic acid, for example within 10, 5, 4, 3, 2, or 1 nucleotide of the 3' end, for example the 3' end nucleotide, comprises a 2'-deoxy-3'-phosphonoacetate (DP). In certain embodiments, a nucleotide at or near the 3' end of the targeter nucleic acid, for example within 10, 5, 4, 3, 2, or 1 nucleotide of the 3' end, for example the 3' end nucleotide, comprises a 2'-deoxy-3'-thiophosphonoacetate (DSP). In embodiments in which a nucleotide at or near the 3' end of the targeter nucleic acid, for example within 10, 5, 4, 3, 2, or 1 nucleotides of the 3' end, for example the 3' end nucleotide, is modified, one or more other nucleotides at or near the 3' end are also modified, for example, an additional 1, 2, 3, 4, 5, 6, 7, 8, or 9 nucleotides are also modified, for example with one or more of the modifications just described.

In certain embodiments, a targeter nucleic acid in a dual gNA, e.g., dual gRNA, comprises at least one nucleotide at or near the 5' end comprising a modification to a ribose, phosphate internucleotide linkage, nucleobase, or terminal modification. In certain embodiments, the 5' end of the targeter nucleic acid comprises the spacer sequence. In certain embodiments, the 5' end of the targeter nucleic acid comprises the targeter stem sequence.

In certain embodiments, a nucleotide or internucleotide linkage within 15, 10, 5, 4, 3, 2, or 1 nucleotides of the 5' end of the targeter nucleic acid is modified. In certain embodiments, the nucleotide or internucleotide linkage at or near the 5' end of the targeter nucleic acid is modified. In certain embodiments, 2, 3, 4, 5, 6, 7, 8, 9, or 10 nucleotides or internucleotide linkages within 15, 10, 5, 4, 3, or 2, or nucleotides of the 5' end of the targeter nucleic acid (as appropriate for total number of nucleotides or internucleotide linkages modified) of the targeter nucleic acid are modified, wherein the modified nucleotides or internucleotide linkages can have the same modification, different modification, or any combination thereof. In certain embodiments, modifications can include 2'-O-methyl (M), a phosphorothioate(S), a phosphonoacetate (P), a thiophosphonoacetate (SP), a 2'-O-methyl-3'-phosphorothioate (MS), a 2'-O-methyl-3'-phosphonoacetate (MP), a 2'-O-methyl-3'-thiophosphonoacetate (MSP), a 2'-deoxy-3'-phosphonoacetate (DP), a 2'-deoxy-3'-thiophosphonoacetate (DSP), or a combination thereof, at or near the 5' end of the targeter nucleic acid. In certain embodiments, a nucleotide at or near the 5' end of the targeter nucleic acid, for example within 10, 5, 4, 3, 2, or 1 nucleotide of the 5' end, for example the 5' end nucleotide, comprises a 2'-O-methyl (M). In certain embodiments, an internucleotide linkage at or near the 5' end of the targeter nucleic acid, for example within 10, 5, 4, 3, 2, or 1 internucleotide linkage of the 5' end, for example the 5' end internucleotide linkage, comprises a phosphorothioate (S). In certain embodiments, an internucleotide linkage at or near the 5' end of the targeter nucleic acid, for example within 10, 5, 4, 3, 2, or 1 internucleotide linkage of the 5' end, for example the 5' end internucleotide linkage, comprises a phosphonoacetate (P). In certain embodiments, an internucleotide linkage at or near the 5' end of the targeter nucleic acid, for example within 10, 5, 4, 3, 2, or 1 internucleotide linkage of the 5' end, for example the 5' end nucleotide, comprises a thiophosphonoacetate (SP). In certain embodiments, a nucleotide at or near the 5' end of the targeter nucleic acid, for example within 10, 5, 4, 3, 2, or 1 nucleotide of the 5' end, for example the 5' end nucleotide, comprises a 2'-O-methyl-3'-phosphorothioate (MS). In certain embodiments, a nucleotide at or near the 5' end of the targeter nucleic acid, for example within 10, 5, 4, 3, 2, or 1 nucleotide of the 5' end, for example the 5' end nucleotide, comprises a 2'-O-methyl-3'-phosphonoacetate (MP). In certain embodiments, a nucleotide at or near the 5' end of the targeter nucleic acid, for example within 10, 5, 4, 3, 2, or 1 nucleotide of the 5' end, for example the 5' end nucleotide, comprises a 2'-O-methyl-3'-thiophosphonoacetate (MSP). In certain embodiments, a nucleotide at or near the 5' end of the targeter nucleic acid, for example within 10, 5, 4, 3, 2, or 1 nucleotide of the 5' end, for example the 5' end nucleotide, comprises a a 2'-deoxy-3'-phosphonoacetate (DP). In certain embodiments, a nucleotide at or near the 5' end of the targeter nucleic acid, for example within 10, 5, 4, 3, 2, or 1 nucleotide of the 5' end, for example the 5' end nucleotide, comprises a 2'-deoxy-3'-thiophosphonoacetate (DSP). In embodiments in which a nucleotide or internucleotide linkage at or near the 5' end of the targeter nucleic acid, for example within 10, 5, 4, 3, 2, or 1 nucleotide of the 5' end, for example the 5' end nucleotide or internucleotide linkage, is modified, one or more other nucleotides or internucleotide linkages at or near the 5' end are also modified, for example, an additional 1, 2, 3, 4, 5, 6, 7, 8, or 9 nucleotides or internucleotide linkages are modified, for example with one or more of the modifications just described.

In certain embodiments, a modulator nucleic acid in a dual gNA, e.g., dual gRNA, comprises at least one nucleotide or internucleotide linkage at or near the 3' end comprising a modification to a ribose, phosphate internucleotide linkage, nucleobase, or terminal modification. In certain embodiments, the 3' end of the modulator nucleic acid comprises a modulator stem sequence. In certain embodiments, the 5' end of the modulator nucleic acid includes a 5' sequence, e.g., a tail sequence. In certain embodiments, one or more nucleotides or internucleotide linkage within 15, 10, 5, 4, 3, 2, or 1 nucleotides of the 3' end of the modulator nucleic acid is modified. In certain embodiments, the nucleotide or internucleotide linkage at or near the 3' end of the modulator nucleic acid is modified. In certain embodiments, 2, 3, 4, 5, 6, 7, 8, 9, or 10 nucleotides or internucleotide linkage within 15, 10, 5, 4, 3, or 2, or nucleotides of the 3' end of the modulator nucleic acid (as appropriate for total number of nucleotides modified) of the modulator nucleic acid are modified, wherein the modified nucleotides or internucleotide linkages can have the same modification, different modification, or any combination thereof. In certain embodiments, modifications can include 2'-O-methyl (M), a phosphorothioate(S), a phosphonoacetate (P), a thiophosphonoacetate (SP), a 2'-O-methyl-3'-phosphorothioate (MS), a 2'-O-methyl-3'-phosphonoacetate (MP), a 2'-O-methyl-3'-thiophosphonoacetate (MSP), a 2'-deoxy-3'-phosphonoacetate (DP), a 2'-deoxy-3'-thiophosphonoacetate (DSP), or a combination thereof, at or near the 3' end of the modulator nucleic acid. In certain embodiments, a nucleotide at or near the 3' end of the modulator nucleic acid, for example within 10, 5, 4, 3, 2, or 1 nucleotide of the 3' end, for example the 3' end nucleotide, comprises a 2'-O-methyl (M). In certain embodiments, an internucleotide linkage at or near the 3' end of the modulator nucleic acid, for example within 10, 5, 4, 3, 2, or 1 internucleotide linkages of the 3' end, for example the 3' end internucleotide linkage, comprises a phosphorothioate(S). In certain embodiments, an internucleotide linkage at or near the 3' end of the modulator nucleic acid, for example within 10, 5, 4, 3, 2, or 1 internucleotide linkage of the 3' end, for example the 3' end internucleotide linkage, comprises a phosphonoacetate (P). In certain embodiments, an internucleotide linkage at or near the 3' end of the modulator nucleic acid, for example within 10, 5, 4, 3, 2, or 1 internucleotide linkage of the 3' end, for example the 3' end internucleotide linkage, comprises a thiophosphonoacetate (SP). In certain embodiments, a nucleotide at or near the 3' end of the modulator nucleic acid, for example within 10, 5, 4, 3, 2, or 1 nucleotide of the 3' end, for example the 3' end nucleotide, comprises a 2'-O-methyl-3'-phosphorothioate (MS). In certain embodiments, a nucleotide at or near the 3' end of the modulator nucleic acid, for example within 10, 5, 4, 3, 2, or 1 nucleotide of the 3' end, for example the 3' end nucleotide, comprises a 2'-O-methyl-3'-phosphonoacetate (MP). In certain embodiments, a nucleotide at or near the 3' end of the modulator nucleic acid, for example within 10, 5, 4, 3, 2, or 1 nucleotide of the 3' end, for example the 3' end nucleotide, comprises a 2'-O-methyl-3'-thiophosphonoacetate (MSP). In certain embodiments, a nucleotide at or near the 3' end of the modulator nucleic acid, for example within 10, 5, 4, 3, 2, or 1 nucleotide of the 3' end, for example the 3' end nucleotide, comprises a a 2'-deoxy-3'-phosphonoacetate (DP). In certain embodiments, a nucleotide at or near the 3' end of the modulator nucleic acid, for example within 10, 5, 4, 3, 2, or 1 nucleotide of the 3' end, for example the 3' end nucleotide, comprises a 2'-deoxy-3'-thiophosphonoacetate (DSP). In embodiments in which a nucleotide or internucleotide linkage at or near the 3' end of the modulator nucleic acid, for example within 10, 5, 4, 3, 2, or 1 nucleotide of the 3' end, for example the 3' end nucleotide or internucleotide linkage, is modified, one or more other nucleotides or internucleotide linkages at or near the 3' end are also modified, for example, an additional 1, 2, 3, 4, 5, 6, 7, 8, or 9 nucleotides or internucleotide linkages are modified, for example with one or more of the modifications just described.

In certain embodiments, a modulator nucleic acid, e.g., RNA, such as a single or dual gNA, e.g., single or dual gRNA, comprises at least one nucleotide at or near the 5' end comprising a modification to a ribose, phosphate group, nucleobase, or terminal modification. In certain embodiments, the 3' end of the modulator nucleic acid of a dual gNA comprises the modulator stem sequence. In certain embodiments, the 5' end of the modulator nucleic acid comprises a 5' sequence, e.g., a tail sequence. In certain embodiments, a nucleotide or internucleotide linkage within 15, 10, 5, 4, 3, 2, or 1 nucleotides of the 5' end of the modulator nucleic acid is modified. In certain embodiments, the nucleotide or internucleotide linkage at or near the 5' end of the modulator nucleic acid is modified. In certain embodiments, 2, 3, 4, 5, 6, 7, 8, 9, or 10 nucleotides or internucleotide linkages within 15, 10, 5, 4, 3, or 2, or nucleotides of the 5' end of the modulator nucleic acid (as appropriate for total number of nucleotides modified) of the modulator nucleic acid are modified, wherein the modified nucleotides or internucleotide linkages can have the same modification, different modification, or any combination thereof. In certain embodiments, modifications can include 2'-O-methyl (M), a phosphorothioate(S), a phosphonoacetate (P), a thiophosphonoacetate (SP), a 2'-O-methyl-3'-phosphorothioate (MS), a 2'-O-methyl-3'-phosphonoacetate (MP), a 2'-O-methyl-3'-thiophosphonoacetate (MSP), a 2'-deoxy-3'-phosphonoacetate (DP), a 2'-deoxy-3'-thiophosphonoacetate (DSP), or a combination thereof, at or near the 5' end of the modulator nucleic acid. In certain embodiments, a nucleotide at or near the 5' end of the modulator nucleic acid, for example within 10, 5, 4, 3, 2, or 1 nucleotide of the 5' end, for example the 5' end nucleotide, comprises a 2'-O-methyl (M). In certain embodiments, an internucleotide linkage at or near the 5' end of the modulator nucleic acid, for example within 10, 5, 4, 3, 2, or 1 internucleotide linkage of the 5' end, for example the 5' end internucleotide linkage, comprises a phosphorothioate(S). In certain embodiments, an internucleotide linkage at or near the 5' end of the modulator nucleic acid, for example within 10, 5, 4, 3, 2, or 1 internucleotide linkage of the 5' end, for example the 5' end internucleotide linkage, comprises a phosphonoacetate (P). In certain embodiments, an internucleotide linkage at or near the 5' end of the modulator nucleic acid, for example within 10, 5, 4, 3, 2, or 1 internucleotide linkage of the 5' end, for example the 5' end internucleotide linkage, comprises a thiophosphonoacetate (SP). In certain embodiments, a nucleotide at or near the 5' end of the modulator nucleic acid, for example within 10, 5, 4, 3, 2, or 1 nucleotide of the 5' end, for example the 5' end nucleotide, comprises a 2'-O-methyl-3'-phosphorothioate (MS). In certain embodiments, a nucleotide at or near the 5' end of the modulator nucleic acid, for example within 10, 5, 4, 3, 2, or 1 nucleotide of the 5' end, for example the 5' end nucleotide, comprises a 2'-O-methyl-3'-phosphonoacetate (MP). In certain embodiments, a nucleotide at or near the 5' end of the modulator nucleic acid, for example within 10, 5, 4, 3, 2, or 1 nucleotide of the 5' end, for example the 5' end nucleotide, comprises a 2'-O-methyl-3'-thiophosphonoacetate (MSP). In certain embodiments, a nucleotide at or near the 5' end of the modulator nucleic acid, for example within 10, 5, 4, 3, 2, or 1 nucleotide of the 5' end, for example the 5' end nucleotide, comprises a a 2'-deoxy-3'-phosphonoacetate (DP). In certain embodiments, a nucleotide at or near the 5' end of the modulator nucleic acid, for example within 10, 5, 4, 3, 2, or 1 nucleotide of the 5' end, for example the 5' end nucleotide, comprises a 2'-deoxy-3'-thiophosphonoacetate (DSP). In embodiments in which a nucleotide or internucleotide linkage at or near the 5' end of the modulator nucleic acid, for example within 10, 5, 4, 3, 2, or 1 nucleotide of the 5' end, for example the 5' end nucleotide or internucleotide linkage, is modified, one or more other nucleotides or internucleotide linkages at or near the 5' end are also modified, for example, an additional 1, 2, 3, 4, 5, 6, 7, 8, or 9 nucleotides or internucleotide linkages are modified, for example with one or more of the modifications just described.

In embodiments in which one or more nucleotides or internucleotide linkages at or near the 3' end of the targeter nucleic acid in a dual gNA, for example within 10, 5, 4, 3, 2, or 1 nucleotide of the 3' end, for example the 3' end nucleotide or internucleotide linkage, is modified, one or more nucleotides or internucleotide linkages at or near the 5' end of the targeter nucleic acid, for example, within 10, 5, 4, 3, 2, or 1 nucleotide of the 5' end, for example the 5' end nucleotide or internucleotide linkage, is also modified. In certain embodiments, a nucleotide at or near the 5' end of the targeter nucleic acid, for example within 10, 5, 4, 3, 2, or 1 nucleotide of the 5' end, for example the 5' end nucleotide, comprises a 2'-O-methyl (M). In certain embodiments, an internucleotide linkage at or near the 5' end of the targeter nucleic acid, for example within 10, 5, 4, 3, 2, or 1 internucleotide linkage of the 5' end, for example the 5' end internucleotide linkage, comprises a phosphorothioate(S). In certain embodiments, an internucleotide linkage at or near the 5' end of the targeter nucleic acid, for example within 10, 5, 4, 3, 2, or 1 internucleotide linkage of the 5' end, for example the 5' end internucleotide linkage, comprises a phosphonoacetate (P). In certain embodiments, an internucleotide linkage at or near the 5' end of the targeter nucleic acid, for example within 10, 5, 4, 3, 2, or 1 internucleotide linkage of the 5' end, for example the 5' end internucleotide linkage, comprises a thiophosphonoacetate (SP). In certain embodiments, a nucleotide at or near the 5' end of the targeter nucleic acid, for example within 10, 5, 4, 3, 2, or 1 nucleotide of the 5' end, for example the 5' end nucleotide, comprises a 2'-O-methyl-3'-phosphorothioate (MS). In certain embodiments, a nucleotide at or near the 5' end of the targeter nucleic acid, for example within 10, 5, 4, 3, 2, or 1 nucleotide of the 5' end, for example the 5' end nucleotide, comprises a 2'-O-methyl-3'-phosphonoacetate (MP). In certain embodiments, a nucleotide at or near the 5' end of the targeter nucleic acid, for example within 10, 5, 4, 3, 2, or 1 nucleotide of the 5' end, for example the 5' end nucleotide, comprises a 2'-O-methyl-3'-thiophosphonoacetate (MSP). In certain embodiments, a nucleotide at or near the 5' end of the targeter nucleic acid, for example within 10, 5, 4, 3, 2, or 1 nucleotide of the 5' end, for example the 5' end nucleotide, comprises a 2'-deoxy-3'-phosphonoacetate (DP). In certain embodiments, a nucleotide at or near the 5' end of the targeter nucleic acid, for example within 10, 5, 4, 3, 2, or 1 nucleotide of the 5' end, for example the 5' end nucleotide, comprises a 2'-deoxy-3'-thiophosphonoacetate (DSP). In embodiments in which a nucleotide or internucleotide linkage at or near the 3' end of the targeter nucleic acid, for example within 10, 5, 4, 3, 2, or 1 nucleotide of the 3' end, for example the 3' end nucleotide or internucleotide linkage, is modified, and a nucleotide or internucleotide linkage at or near the 5' end of the targeter nucleic acid, for example within 10, 5, 4, 3, 2, or 1 nucleotide of the 5' end, for example the 5' end nucleotide or internucleotide linkage, is modified, one or more other nucleotides or internucleotide linkage at or near the 5' end are also modified, for example, an additional 1, 2, 3, 4, 5, 6, 7, 8, or 9 nucleotides or internucleotide linkages are modified, for example with one or more of the modifications just described.

In embodiments in which one or more nucleotides or internucleotide linkages at or near the 3' end of the targeter nucleic acid, for example within 10, 5, 4, 3, 2, or 1 nucleotides of the 3' end, for example the 3' end nucleotide or internucleotide linkage, is modified, and/or one or more nucleotides or internucleotide linkages at or near the 5' end of the targeter nucleic acid, for example within 10, 5, 4, 3, 2, or 1 nucleotides of the 5' end, for example the 5' end nucleotide or internucleotide linkage, is modified, a nucleotide or internucleotide linkage at or near the 3' end of a modulator nucleic acid, for example, within 10, 5, 4, 3, 2, or 1 nucleotide of the 3' end, for example the 3' end nucleotide or internucleotide linkage, is also modified. In certain embodiments, a nucleotide at or near the 3' end of the modulator nucleic acid, for example within 10, 5, 4, 3, 2, or 1 nucleotide of the 3' end, for example the 3' end nucleotide, comprises a 2'-O-methyl (M). In certain embodiments, an internucleotide linkage at or near the 3' end of the modulator nucleic acid, for example within 10, 5, 4, 3, 2, or 1 internucleotide linkage of the 3' end, for example the 3' end internucleotide linkage, comprises a phosphorothioate(S). In certain embodiments, an internucleotide linkage at or near the 3' end of the modulator nucleic acid, for example within 10, 5, 4, 3, 2, or 1 internucleotide linkage of the 3' end, for example the 3' end internucleotide linkage, comprises a phosphonoacetate (P). In certain embodiments, an internucleotide linkage at or near the 3' end of the modulator nucleic acid, for example within 10, 5, 4, 3, 2, or 1 internucleotide linkage of the 3' end, for example the 3' end internucleotide linkage, comprises a thiophosphonoacetate (SP). In certain embodiments, a nucleotide at or near the 3' end of the modulator nucleic acid, for example within 10, 5, 4, 3, 2, or 1 nucleotide of the 3' end, for example the 3' end nucleotide, comprises a 2'-O-methyl-3'-phosphorothioate (MS). In certain embodiments, a nucleotide at or near the 3' end of the modulator nucleic acid, for example within 10, 5, 4, 3, 2, or 1 nucleotide of the 3' end, for example the 3' end nucleotide, comprises a 2'-O-methyl-3'-phosphonoacetate (MP). In certain embodiments, a nucleotide at or near the 3' end of the modulator nucleic acid, for example within 10, 5, 4, 3, 2, or 1 nucleotide of the 3' end, for example the 3' end nucleotide, comprises a 2'-O-methyl-3'-thiophosphonoacetate (MSP). In certain embodiments, a nucleotide at or near the 3' end of the modulator nucleic acid, for example within 10, 5, 4, 3, 2, or 1 nucleotide of the 3' end, for example the 3' end nucleotide, comprises a a 2'-deoxy-3'-phosphonoacetate (DP). In certain embodiments, a nucleotide at or near the 3' end of the modulator nucleic acid, for example within 10, 5, 4, 3, 2, or 1 nucleotide of the 3' end, for example the 3' end nucleotide, comprises a 2'-deoxy-3'-thiophosphonoacetate (DSP). In embodiments in which a nucleotide or internucleotide linkage at or near the 3' end of the modulator nucleic acid, for example within 10, 5, 4, 3, 2, or 1 nucleotide of the 3' end, for example the 3' end nucleotide or internucleotide linkage, is modified, one or more other nucleotides or internucleotide linkages at or near the 3' end are also modified, for example, an additional 1, 2, 3, 4, 5, 6, 7, 8, or 9 nucleotides or internucleotide linkages are modified, for example with one or more of the modifications just described.

In embodiments in which one or more nucleotides or internucleotide linkages at or near the 3' end of the targeter nucleic acid, for example within 10, 5, 4, 3, 2, or 1 nucleotides of the 3' end, for example the 3' end nucleotide or internucleotide linkage, is modified, and/or one or more nucleotides or internucleotide linkages at or near the 5' end of the targeter nucleic acid, for example within 10, 5, 4, 3, 2, or 1 nucleotides of the 5' end, for example the 5' end nucleotide or internucleotide linkage, is modified, and/or one or more nucleotides or internucleotide linkages at or near the 3' end of a modulator nucleic acid, for example, within 10, 5, 4, 3, 2, or 1 nucleotide of the 3' end, for example the 3' end nucleotide or internucleotide linkage, is modified, one or more nucleotides or internucleotide linkages at or near the 5' end of a modulator nucleic acid, for example, within 10, 5, 4, 3, 2, or 1 nucleotide of the 5' end, for example the 5' end nucleotide or internucleotide linkage, is modified. In certain embodiments, a nucleotide at or near the 5' end of the modulator nucleic acid, for example within 10, 5, 4, 3, 2, or 1 nucleotide of the 5' end, for example the 5' end nucleotide, comprises a 2'-O-methyl (M). In certain embodiments, an internucleotide linkage at or near the 5' end of the modulator nucleic acid, for example within 10, 5, 4, 3, 2, or 1 internucleotide linkage of the 5' end, for example the 5' end internucleotide linkage, comprises a phosphorothioate(S). In certain embodiments, an internucleotide linkage at or near the 5' end of the modulator nucleic acid, for example within 10, 5, 4, 3, 2, or 1 internucleotide linkage of the 5' end, for example the 5' end internucleotide linkage, comprises a phosphonoacetate (P). In certain embodiments, an internucleotide linkage at or near the 5' end of the modulator nucleic acid, for example within 10, 5, 4, 3, 2, or 1 internucleotide linkage of the 5' end, for example the 5' end internucleotide linkage, comprises a thiophosphonoacetate (SP). In certain embodiments, a nucleotide at or near the 5' end of the modulator nucleic acid, for example within 10, 5, 4, 3, 2, or 1 nucleotide of the 5' end, for example the 5' end nucleotide, comprises a 2'-O-methyl-3'-phosphorothioate (MS). In certain embodiments, a nucleotide at or near the 5' end of the modulator nucleic acid, for example within 10, 5, 4, 3, 2, or 1 nucleotide of the 5' end, for example the 5' end nucleotide, comprises a 2'-O-methyl-3'-phosphonoacetate (MP). In certain embodiments, a nucleotide at or near the 5' end of the modulator nucleic acid, for example within 10, 5, 4, 3, 2, or 1 nucleotide of the 5' end, for example the 5' end nucleotide, comprises a 2'-O-methyl-3'-thiophosphonoacetate (MSP). In certain embodiments, a nucleotide at or near the 5' end of the modulator nucleic acid, for example within 10, 5, 4, 3, 2, or 1 nucleotide of the 5' end, for example the 5' end nucleotide, comprises a 2'-deoxy-3'-phosphonoacetate (DP). In certain embodiments, a nucleotide at or near the 5' end of the modulator nucleic acid, for example within 10, 5, 4, 3, 2, or 1 nucleotide of the 5' end, for example the 5' end nucleotide, comprises a 2'-deoxy-3'-thiophosphonoacetate (DSP). In embodiments in which a nucleotide or internucleotide linkage at or near the 5' end of the modulator nucleic acid, for example within 10, 5, 4, 3, 2, or 1 nucleotide of the 5' end, for example the 3' end nucleotide or internucleotide linkage, is modified, one or more other nucleotides or internucleotide linkages at or near the 5' end are also modified, for example, an additional 1, 2, 3, 4, 5, 6, 7, 8, or 9 nucleotides or internucleotide linkages are modified, for example with one or more of the modifications just described.

In certain embodiments in which the 3' end of the targeter nucleic acid is unmodified, one or more nucleotides or internucleotide linkages at or near the 5' end of the modulator may be modified. In certain embodiments, the modifications comprise 1, 2, 3, 4, 5, 6, 7, 8, 9, or 10 nucleotides or internucleotide linkages within 15, 14, 13, 12, 11, 10, 9, 8, 7, 6, 5, 4, 3, 2, or 1 nucleotides or internucleotide linkages of the 5' end of the modulator (as appropriate for total number of nucleotides modified), wherein the modified nucleotides or internucleotide linkages can have the same modification, different modification, or any combination thereof. In certain embodiments, the modifications comprise 1-5, 1-4, 1-3, 1-2, 2-4, 2-3, for example 1, 2, 3, 4, or 5, 2'-O-methoxy-3'-phosphorothioate modifications within 5, 4, 3, 2 or 1 (as appropriate for total number of nucleotides modified) nucleotides of the 5' end of the modulator nucleic acid. In certain embodiments, the modifications comprise 1-3, for example 1, 2, or 3, 2'-O-methoxy-3'-phorophothioate modifications within the first 3 nucleotides of the 5' end of the modulator nucleic acid. In a preferred embodiment, the first 2 nucleotides of the 5' end of the modulator nucleic acid are 2'-O-methoxy-3'-phosphorothioate modified. For each of the described embodiments, the 3' nucleotide of the modulator nucleic acid is may be either an A, T, G, C with a preferred terminal nucleotide of either A or C.

In certain embodiments in which the 3' end of the targeter nucleic acid is unmodified, one or more nucleotides or internucleotide linkages at or near the 5' end of the modulator may be modified. In certain embodiments, the modifications comprise 1-17, 2-16, 3-15, 4-14, 5-13, 6-12, 7-11, or 8-10, for example, 1, 2, 3, 4, 5, 6, 7, 8, 9, 10, 11, 12, 13, 14, 15, 16, or 17, phosphorothioate modification within the first 17, 16, 15, 14, 13, 12, 11, 10, 9, 8, 7, 6, 5, 4, 3, 2 or 1 (as appropriate for total number of nucleotides modified) internucleotide linkages of the 5' end of the modulator nucleic acid. In certain embodiments, the modifications comprise 8-10, for example 8, 9 or 10, phosphorothioate modifications within the first 10, 9 or 8 internucleotide linkages (as appropriate for total number of internucleotide linkages modified) of the 5' end of the modulator nucleic acid. In a preferred embodiment, the first 9 internucleotide linkages of the 5' end of the modulator nucleic acid are phosphorothioate modified. For each of the described embodiments, the 3' nucleotide of the modulator nucleic acid is may be either an A, T, G, C with a preferred terminal nucleotide of either A or C.

In certain embodiments in which the 3' end of the targeter nucleic acid is unmodified, one or more nucleotides or internucleotide linkages at or near the 5' end of the modulator may be modified. In certain embodiments, modifications comprise 1-3, for example, 1, 2, or 3, 2'-O-methoxy and/or 1-3, for example, 1, 2, or 3, 3'-phosphorothioate modifications within the first 3 nucleotides (as appropriate for the total number of nucleotides modified) of the 5' end of the modulator nucleic acid. In this embodiment, any combination of 2'-O-methoxy nucleotide modifications and phosphorothioate internucleotide modifications may be used. In a preferred embodiment, the first nucleotide from the 5' end of the modulator nucleic acid is 2'-O-methoxy-3'-phosphorothioate modified and the second internucleotide linkage is phosphorothioate modified. For each of the described embodiments, the 3' nucleotide of the modulator nucleic acid is may be either an A, T, G, C with a preferred terminal nucleotide of either A or C.

In certain embodiments in which the 3' end of the targeter nucleic acid is unmodified, one or more nucleotides or internucleotide linkages at or near the 5' end of the modulator nucleic acid may be modified. In certain embodiments, the 5' end of the modulator nucleic acid is modified with a terminal propanediol. For each of the described embodiments, the 3' nucleotide of the modulator nucleic acid is may be either an A, T, G, C with a preferred terminal nucleotide of either A or C.

In certain embodiments in which the 3' end of the targeter nucleic acid comprises a terminal propanediol modification, one or more nucleotides or internucleotide linkages at or near the 5' end of the modulator nucleic acid may be modified. In certain embodiments, the modifications comprise 1, 2, 3, 4, 5, 6, 7, 8, 9, or 10 nucleotides or internucleotide linkages within 15, 14, 13, 12, 11, 10, 9, 8, 7, 6, 5, 4, 3, 2, or 1 nucleotides or internucleotide linkages of the 5' end of the modulator (as appropriate for total number of nucleotides modified), wherein the modified nucleotides or internucleotide linkages can have the same modification, different modification, or any combination thereof. In certain embodiments, the modifications comprise 1-5, 1-4, 1-3, 1-2, 2-4, 2-3, for example 1, 2, 3, 4, or 5, 2'-O-methoxy-3'-phosphorothioate modifications within 5, 4, 3, 2 or 1 (as appropriate for total number of nucleotides modified) nucleotides of the 5' end of the modulator nucleic acid. In certain embodiments, the modifications comprise 1-3, for example 1, 2, or 3, 2'-O-methoxy-3'-phorophothioate modifications within the first 3 nucleotides of the 5' end of the modulator nucleic acid. In a preferred embodiment, the first 2 nucleotides of the 5' end of the modulator nucleic acid are 2'-O-methoxy-3'-phosphorothioate modified. For each of the described embodiments, the 3' nucleotide of the modulator nucleic acid is may be either an A, T, G, C with a preferred terminal nucleotide of either A or C.

In certain embodiments in which the 3' end of the targeter nucleic acid comprises a terminal propanediol modification, one or more nucleotides or internucleotide linkages at or near the 5' end of the modulator nucleic acid may be modified. In certain embodiments, the modifications comprise 1-17, 2-16, 3-15, 4-14, 5-13, 6-12, 7-11, or 8-10, for example, 1, 2, 3, 4, 5, 6, 7, 8, 9, 10, 11, 12, 13, 14, 15, 16, or 17, phosphorothioate modification within the first 17, 16, 15, 14, 13, 12, 11, 10, 9, 8, 7, 6, 5, 4, 3, 2 or 1 (as appropriate for total number of nucleotides modified) internucleotide linkages of the 5' end of the modulator nucleic acid. In certain embodiments, the modifications comprise 8-10, for example 8, 9 or 10, 3 phosphorothioate modifications within the first 10, 9 or 8 internucleotide linkages (as appropriate for total number of internucleotide linkages modified) of the 5' end of the modulator nucleic acid. In a preferred embodiment, the first 9 internucleotide linkages of the 5' end of the modulator nucleic acid are phosphorothioate modified. For each of the described embodiments, the 3' nucleotide of the modulator nucleic acid is may be either an A, T, G, C with a preferred terminal nucleotide of either A or C.

In certain embodiments in which the 3' end of the targeter nucleic acid comprises a terminal propanediol modification, one or more nucleotides or internucleotide linkages at or near the 5' end of the modulator nucleic acid may be modified. In certain embodiments, modifications comprise 1-3, for example, 1, 2, or 3, 2'-O-methoxy and/or 1-3, for example, 1, 2, or 3, 3'-phosphorothioate modifications within the first 3 nucleotide (as appropriate for the total number of nucleotides modified) of the 5' end of the modulator nucleic acid. In this embodiment, any combination of 2'-O-methoxy and 3'-phosphorothioate modifications may be used. In a preferred embodiment, the first nucleotide from the 5' end of the modulator nucleic acid is 2'-O-methoxy-3'-phosphorothioate modified and the second nucleotide is 3'-phosphorothioate modified. For each of the described embodiments, the 3' nucleotide of the modulator nucleic acid is may be either an A, T, G, C with a preferred terminal nucleotide of either A or C.

In certain embodiments in which the 3' end of the targeter nucleic acid comprises a terminal propanediol modification, one or more nucleotides or internucleotide linkages at or near the 5' end of the modulator nucleic acid may be modified. In certain embodiments, the 5' end of the modulator nucleic acid is modified with a terminal propanediol. For each of the described embodiments, the 3' nucleotide of the modulator nucleic acid is may be either an A, T, G, C with a preferred terminal nucleotide of either A or C.

In certain embodiments in which the 3' end of the targeter nucleic acid comprises two 2'-O-methoxy-3'-phosphorothioate modifications, one or more nucleotides or internucleotide linkages at or near the 5' end of the modulator nucleic acid may be modified. In certain embodiments, the modifications comprise 1, 2, 3, 4, 5, 6, 7, 8, 9, or 10 nucleotides or internucleotide linkages within 15, 14, 13, 12, 11, 10, 9, 8, 7, 6, 5, 4, 3, 2, or 1 nucleotides or internucleotide linkages of the 5' end of the modulator (as appropriate for total number of nucleotides modified), wherein the modified nucleotides or internucleotide linkages can have the same modification, different modification, or any combination thereof. In certain embodiments, the modifications comprise 1-5, 1-4, 1-3, 1-2, 2-4, 2-3, for example 1, 2, 3, 4, or 5, 2'-O-methoxy-3'-phosphorothioate modifications within 5, 4, 3, 2 or 1 (as appropriate for total number of nucleotides modified) nucleotides of the 5' end of the modulator nucleic acid. In certain embodiments, the the modifications comprise 1-3, for example 1, 2, or 3, 2'-O-methoxy-3'-phorophothioate modifications within the first 3 nucleotides of the 5' end of the modulator nucleic acid. In a preferred embodiment, the first 2 nucleotides of the 5' end of the modulator nucleic acid are 2'-O-methoxy-3'-phosphorothioate modified. For each of the described embodiments, the 3' nucleotide of the modulator nucleic acid is may be either an A, T, G, C with a preferred terminal nucleotide of either A or C.

In certain embodiments in which the 3' end of the targeter nucleic acid comprises two 2'-O-methoxy-3'-phosphorothioate modifications, one or more nucleotides or internucleotide linkages at or near the 5' end of the modulator nucleic acid may be modified. In certain embodiments, the modifications comprise 1-17, 2-16, 3-15, 4-14, 5-13, 6-12, 7-11, or 8-10, for example, 1, 2, 3, 4, 5, 6, 7, 8, 9, 10, 11, 12, 13, 14, 15, 16, or 17, phosphorothioate modifications within the first 17, 16, 15, 14, 13, 12, 11, 10, 9, 8, 7, 6, 5, 4, 3, 2 or 1 (as appropriate for total number of nucleotides modified) internucleotide linkages of the 5' end of the modulator nucleic acid. In certain embodiments, the modifications comprise 8-10, for example 8, 9 or 10, phosphorothioate modifications within the first 10, 9 or 8 internucleotide linkages (as appropriate for total number of nucleotides modified) of the 5' end of the modulator nucleic acid. In a preferred embodiment, the first 9 nucleotides of the 5' end of the modulator nucleic acid are 3'-phosphorothioate modified. For each of the described embodiments, the 3' nucleotide of the modulator nucleic acid is may be either an A, T, G, C with a preferred terminal nucleotide of either A or C.

In certain embodiments in which the 3' end of the targeter nucleic acid comprises two 2'-O-methoxy-3'-phosphorothioate modifications, one or more nucleotides or internucleotide linkages at or near the 5' end of the modulator nucleic acid may be modified. In certain embodiments, modifications comprise 1-3, for example, 1, 2, or 3, 2'-O-methoxy and/or 1-3, for example, 1, 2, or 3, 3'-phosphorothioate modifications within the first 3 nucleotide (as appropriate for the total number of nucleotides modified) of the 5' end of the modulator nucleic acid. In this embodiment, any combination of 2'-O-methoxy and 3'-phosphorothioate modifications may be used. In a preferred embodiment, the first nucleotide from the 5' end of the modulator nucleic acid is 2'-O-methoxy-3'-phosphorothioate modified and the second nucleotide is 3'-phosphorothioate modified. For each of the described embodiments, the 3' nucleotide of the modulator nucleic acid is may be either an A, T, G, C with a preferred terminal nucleotide of either A or C.

In certain embodiments in which the 3' end of the targeter nucleic acid comprises two 2'-O-methoxy-3'-phosphorothioate modifications, one or more nucleotides or internucleotide linkages at or near the 5' end of the modulator nucleic acid may be modified. In certain embodiments, the 5' end of the modulator nucleic acid is modified with a terminal propanediol. For each of the described embodiments, the 3' nucleotide of the modulator nucleic acid is may be either an A, T, G, C with a preferred terminal nucleotide of either A or C.

In certain embodiments in 3' end of the targeter nucleic acid comprises five 2'-fluoro modifications, one or more nucleotides or internucleotide linkages at or near the 5' end of the modulator nucleic acid may be modified. In certain embodiments, the modifications comprise 1, 2, 3, 4, 5, 6, 7, 8, 9, or 10 nucleotides or internucleotide linkages within 15, 14, 13, 12, 11, 10, 9, 8, 7, 6, 5, 4, 3, 2, or 1 nucleotides or internucleotide linkages of the 5' end of the modulator (as appropriate for total number of nucleotides modified), wherein the modified nucleotides or internucleotide linkages can have the same modification, different modification, or any combination thereof. In certain embodiments, the modifications comprise 1-5, 1-4, 1-3, 1-2, 2-4, 2-3, for example 1, 2, 3, 4, or 5, 2'-O-methoxy-3'-phosphorothioate modifications within 5, 4, 3, 2 or 1 (as appropriate for total number of nucleotides modified) nucleotides of the 5' end of the modulator nucleic acid. In certain embodiments, the the modifications comprise 1-3, for example 1, 2, or 3, 2'-O-methoxy-3'-phorophothioate modifications within the first 3 nucleotides of the 5' end of the modulator nucleic acid. In a preferred embodiment, the first 2 nucleotides of the 5' end of the modulator nucleic acid are 2'-O-methoxy-3'-phosphorothioate modified. For each of the described embodiments, the 3' nucleotide of the moculator nucleic acid nucleic acid is may be either an A, T, G, C with a preferred terminal nucleotide of either A or C.

In certain embodiments in 3' end of the targeter nucleic acid comprises five 2'-fluoro modifications, one or more nucleotides or internucleotide linkages at or near the 5' end of the modulator nucleic acid may be modified. In certain embodiments, the modifications comprise 1-17, 2-16, 3-15, 4-14, 5-13, 6-12, 7-11, or 8-10, for example, 1, 2, 3, 4, 5, 6, 7, 8, 9, 10, 11, 12, 13, 14, 15, 16, or 17, phosphorothioate modification within the first 17, 16, 15, 14, 13, 12, 11, 10, 9, 8, 7, 6, 5, 4, 3, 2 or 1 (as appropriate for total number of nucleotides modified) internucleotide linkages of the 5' end of the modulator nucleic acid. In certain embodiments, the modifications comprise 8-10, for example 8, 9 or 10, phosphorothioate modifications within the first 10, 9 or 8 internucleotide linkages (as appropriate for total number of nucleotides modified) of the 5' end of the modulator nucleic acid. In a preferred embodiment, the first 9 internucleotide linkages of the 5' end of the modulator nucleic acid are phosphorothioate modified. For each of the described embodiments, the 3' nucleotide of the modulator nucleic acid is may be either an A, T, G, C with a preferred terminal nucleotide of either A or C.

In certain embodiments in 3' end of the targeter nucleic acid comprises five 2'-fluoro modifications, one or more nucleotides or internucleotide linkages at or near the 5' end of the modulator nucleic acid may be modified. In certain embodiments, modifications comprise 1-3, for example, 1, 2, or 3, 2'-O-methoxy and/or 1-3, for example, 1, 2, or 3, 3'-phosphorothioate modifications within the first 3 nucleotides or internucleotide linkages (as appropriate for the total number of nucleotides or internucleotide linkages modified) of the 5' end of the modulator nucleic acid. In this embodiment, any combination of 2'-O-methoxy and phosphorothioate modifications may be used. In a preferred embodiment, the first nucleotide from the 5' end of the modulator nucleic acid is 2'-O-methoxy-3'-phosphorothioate modified and the second internucleotide linkage is phosphorothioate modified. For each of the described embodiments, the 3' nucleotide of the modulator nucleic acid is may be either an A, T, G, C with a preferred terminal nucleotide of either A or C.

In certain embodiments in 3' end of the targeter nucleic acid comprises five 2'-fluoro modifications, one or more nucleotides or internucleotide linkages at or near the 5' end of the modulator nucleic acid may be modified. In certain embodiments, the 5' end of the modulator nucleic acid is modified with a terminal propanediol. For each of the described embodiments, the 3' nucleotide of the modulator nucleic acid is may be either an A, T, G, C with a preferred terminal nucleotide of either A or C.

In certain embodiments the modulator nucleic acid comprises any one of SEQ ID NOs: 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, or 1037. In certain embodiments, the targeter nucleic acid comprises a stem sequence complementary to a modulator stem sequence of any one of SEQ ID NOs: 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, or 1037 and a spacer sequence that may hybridize with a target nucleotide sequence in a target DNA of interest to a skilled artisan. Such a targeter nucleic acid may comprise any composition of modifications as described herein.

In certain embodiments, modulator and targeter nucleic acids comprise a single polynucleotide wherein the stem sequence of the modulator is in physically connection to the stem sequence of the targeter nucleic acid through a linker, e.g., a loop sequence or a chemical spacer sequence, e.g., a propanediol linker and the like. In certain embodiments, modulator and target nucleic acids are separate polynucleotides. In either of these embodiments, the gNA may comprise any combination of chemical modification as desired by one skilled in the art.

In certain embodiments, the modification alters the specificity of the engineered, non-naturally occurring system. In certain embodiments, the modification enhances the specificity of the engineered, non-naturally occurring system, e.g., by enhancing on-target binding and/or cleavage, or reducing off-target binding and/or cleavage, or a combination thereof. Specificity-enhancing modifications include but are not limited to 2-thiouracil, 2-thiocytosine, 4-thiouracil, 6-thioguanine, 2-aminoadenine, and pseudouracil. Within 10, 5, 4, 3, 2, or 1 nucleotide of the 3' end, for example the 3' end nucleotide, is modified In certain embodiments, the modification alters the immunostimulatory effect of the RNA relative to a corresponding RNA without the modification. For example, in certain embodiments, the modification reduces the ability of the RNA to activate TLR7, TLR8, TLR9, TLR3, RIG-I, and/or MDA5.

In certain embodiments, the targeter nucleic acid and/or the modulator nucleic acid comprise at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 modified nucleotides or internucleotide linkages. The modification can be made at one or more positions in the targeter nucleic acid and/or the modulator nucleic acid such that these nucleic acids retain functionality. For example, the modified nucleic acids can still direct the Cas protein to the target nucleotide sequence and allow the Cas protein to exert its effector function. It is understood that the particular modification(s) at a position may be selected based on the functionality of the nucleotide or internucleotide linkage at the position. For example, a specificity-enhancing modification may be suitable for a nucleotide or internucleotide linkage in the spacer sequence, the targeter stem sequence, or the modulator stem sequence. A stability-enhancing modification may be suitable for one or more terminal nucleotides or internucleotide linkages in the targeter nucleic acid and/or the modulator nucleic acid. In certain embodiments, at least 1 (e.g., at least 2, at least 3, at least 4, or at least 5) terminal nucleotides or internucleotide linkages at or near the 5' end and/or at least 1 (e.g., at least 2, at least 3, at least 4, or at least 5) terminal nucleotides or internucleotide linkages at or near the 3' end of the targeter nucleic acid are modified. In certain embodiments, 5 or fewer (e.g., 1 or fewer, 2 or fewer, 3 or fewer, or 4 or fewer) terminal nucleotides or internucleotide linkages at or near the 5' end and/or 5 or fewer (e.g., 1 or fewer, 2 or fewer, 3 or fewer, or 4 or fewer) terminal nucleotides or internucleotide linkages at or near the 3' end of the targeter nucleic acid are modified. In certain embodiments, at least 1 (e.g., at least 2, at least 3, at least 4, or at least 5) terminal nucleotides or internucleotide linkages at or near the 5' end and/or at least 1 (e.g., at least 2, at least 3, at least 4, or at least 5) terminal nucleotides or internucleotide linkages at or near the 3' end of the modulator nucleic acid are modified. In certain embodiments, 5 or fewer (e.g., 1 or fewer, 2 or fewer, 3 or fewer, or 4 or fewer) terminal nucleotides or internucleotide linkages at or near the 5' end and/or 5 or fewer (e.g., 1 or fewer, 2 or fewer, 3 or fewer, or 4 or fewer) terminal nucleotides or internucleotide linkages at or near the 3' end of the modulator nucleic acid are modified. Selection of positions for modifications is described in U.S. Pat. Nos. 10,900,034 and 10,767,175. As used in this paragraph, where the targeter or modulator nucleic acid is a combination of DNA and RNA, the nucleic acid as a whole is considered as an RNA, and the DNA nucleotide(s) are considered as modification(s) of the RNA, including a 2'-H modification of the ribose and optionally a modification of the nucleobase.

It is understood that, in dual guide nucleic acid systems the targeter nucleic acid and the modulator nucleic acid, while not in the same nucleic acids, i.e., not linked end-to-end through a traditional internucleotide bond, can be covalently conjugated to each other through one or more chemical modifications introduced into these nucleic acids, thereby increasing the stability of the double-stranded complex and/or improving other characteristics of the system.

B. Targeter and Modulator Nucleic Acids

The engineered, non-naturally occurring systems provided herein comprise a targeter nucleic acid and a modulator nucleic acid, one or both of which contains a modification of one or more nucleotides or internucleotide linkages at or near 3' end, at or near the 5', or at or near both ends, that, when hybridized to form a complex, are capable of activating a Cas nuclease disclosed herein. In certain embodiments, the Cas nuclease is activated by a single crRNA in the absence of a tracrRNA in a naturally occurring system. In certain embodiments, the Cas nuclease is a Type I, II, III, IV, V, or VI nuclease. In certain embodiments, the Cas nuclease is a Type V nuclease. In certain embodiments, the Cas nuclease is a type V-A, type V-C, or type V-D nuclease. In certain embodiments, the Cas nuclease is a Type V-A nuclease.

The term "targeter nucleic acid," as used herein, includes a nucleic acid comprising (i) a spacer sequence designed to hybridize with a target nucleotide sequence; and (ii) a targeter stem sequence capable of hybridizing with an additional nucleic acid to form a complex, wherein the complex is capable of activating a Cas nuclease (e.g., a type V-A Cas nuclease) under suitable conditions, and wherein the targeter nucleic acid alone, in the absence of the additional nucleic acid, is not capable of activating the Cas nuclease under the same conditions.

The term "modulator nucleic acid," as used herein in connection with a given targeter nucleic acid and its corresponding Cas nuclease, includes a nucleic acid capable of hybridizing with the targeter nucleic acid to form a complex, wherein the complex, but not the modulator nucleic acid alone, is capable of activating the type Cas nuclease under suitable conditions.

The term "suitable conditions," as used in the definitions of "targeter nucleic acid" and "modulator nucleic acid," includes the conditions under which a naturally occurring CRISPR-Cas system is operative, such as in a prokaryotic cell, in a eukaryotic (e.g., mammalian or human) cell, or in an in vitro assay.

The targeter nucleic acid and/or the modulator nucleic acid can be synthesized chemically or produced in a biological process (e.g., catalyzed by an RNA polymerase in an in vitro reaction). Such reaction or process may limit the lengths of the targeter and modulator nucleic acids. In certain embodiments, the target nucleic acid is no more than 100, 90, 80, 70, 60, 50, 40, 30, or 25 nucleotides in length. In certain embodiments, the target nucleic acid is at least 20, 25, 30, 40, 50, 60, 70, 80, or 90 nucleotides in length. In certain embodiments, the target nucleic acid is 20-100, 20-90, 20-80, 20-70, 20-60, 20-50, 20-40, 20-30, 20-25, 25-100, 25-90, 25-80, 25-70, 25-60, 25-50, 25-40, 25-30, 30-100, 30-90, 30-80, 30-70, 30-60, 30-50, 30-40, 40-100, 40-90, 40-80, 40-70, 40-60, 40-50, 50-100, 50-90, 50-80, 50-70, 50-60, 60-100, 60-90, 60-80, 60-70, 70-100, 70-90, 70-80, 80-100, 80-90, or 90-100 nucleotides in length. In certain embodiments, the modulator nucleic acid is no more than 100, 90, 80, 70, 60, 50, 40, 30, or 20 nucleotides in length. In certain embodiments, the modulator nucleic acid is at least 10, 15, 20, 25, 30, 40, 50, 60, 70, 80, or 90 nucleotides in length. In certain embodiments, the modulator nucleic acid is 10-100, 10-90, 10-80, 10-70, 10-60, 10-50, 10-40, 10-30, 10-20, 15-100, 15-90, 15-80, 15-70, 15-60, 15-50, 15-40, 15-30, 15-20, 20-100, 20-90, 20-80, 20-70, 20-60, 20-50, 20-40, 20-30, 25-100, 25-90, 25-80, 25-70, 25-60, 25-50, 25-40, 25-30, 30-100, 30-90, 30-80, 30-70, 30-60, 30-50, 30-40, 40-100, 40-90, 40-80, 40-70, 40-60, 40-50, 50-100, 50-90, 50-80, 50-70, 50-60, 60-100, 60-90, 60-80, 60-70, 70-100, 70-90, 70-80, 80-100, 80-90, or 90-100 nucleotides in length.

Figure 1B:

In naturally occurring type V-A CRISPR-Cas systems, the crRNA comprises a scaffold sequence (also called direct repeat sequence) and a spacer sequence that hybridizes with the target nucleotide sequence. In certain naturally occurring type V-A CRISPR-Cas systems, the scaffold sequence forms a stem-loop structure in which the stem consists of five consecutive base pairs. A dual guide type V-A CRISPR-Cas system may be derived from a naturally occurring type V-A CRISPR-Cas system, or a variant thereof in which the Cas protein is guided to the target nucleotide sequence by a crRNA alone, such system referred to herein as a "single guide type V-A CRISPR-Cas system." In certain modified dual guide type V-A CRISPR-Cas systems disclosed herein, the targeter nucleic acid comprises the chain of the stem sequence between the spacer and the loop (the "targeter stem sequence") and the spacer sequence, and the modulator nucleic acid comprises the other chain of the stem sequence (the "modulator stem sequence") and the 5' sequence, e.g., a tail sequence, positioned 5' to the modulator stem sequence. The targeter stem sequence is 100% complementary to the modulator stem sequence. As such, the double-stranded complex of the targeter nucleic acid and the modulator nucleic acid retains the orientation of the 5' sequence, e.g., a tail sequence, the modulator stem sequence, the targeter stem sequence, and the spacer sequence of a single guide type V-A CRISPR-Cas system but lacks the loop structure between the modulator stem sequence and the targeter stem sequence. A schematic representation of an exemplary double-stranded complex is shown in FIG. 1.

Notwithstanding the general structural similarity, it has been discovered that the stem-loop structure of the crRNA in a naturally occurring type V-A CRISPR complex is dispensable for the functionality of the CRISPR system. This discovery is surprising because the prior art has suggested that the stem-loop structure is critical (see, Zetsche et al. (2015) CELL, 163:759) and that removal of the loop structure by "splitting" the crRNA abrogated the activity of a AsCpf1 CRISPR system (see, Li et al. (2017) NAT. BIOMED. ENG., 1:0066).

It is contemplated that the length of the duplex may be a factor in providing an operative modified dual guide CRISPR system. In certain embodiments, the targeter stem sequence and the modulator stem sequence each consist of 4-10 nucleotides that base pair with each other. In certain embodiments, the targeter stem sequence and the modulator stem sequence each consist of 4-9, 4-8, 4-7, 4-6, 4-5, 5-10, 5-9, 5-8, 5-7, or 5-6 nucleotides that base pair with each other. In certain embodiments, the targeter stem sequence and the modulator stem sequence each consist of 4, 5, 6, 7, 8, 9, or 10 nucleotides. It is understood that the composition of the nucleotides in each sequence affects the stability of the duplex, and a C-G base pair confers greater stability than an A-U base pair. In certain embodiments, 20%-80%, 20%-70%, 20%-60%, 20%-50%, 20%-40%, 20%-30%, 30%-80%, 30%-70%, 30%-60%, 30%-50%, 30%-40%, 40%-80%, 40%-70%, 40%-60%, 40%-50%, 50%-80%, 50%-70%, 50%-60%, 60%-80%, 60%-70%, or 70%-80% of the base pairs are C-G base pairs. In certain embodiments, the targeter stem sequence and the modulator stem share at least 80%, 85%, 90%, 95%, 99%, 99.5%, or 100% sequence complementarity. In a preferred embodiment, the target stem sequence and the modulator stem sequence share at 80-100% sequence complementarity.

In certain embodiments, the targeter stem sequence and the modulator stem sequence each consist of 5 nucleotides. As such, the targeter stem sequence and the modulator stem sequence form a duplex of 5 base pairs. In certain embodiments, 0-4, 0-3, 0-2, 0-1, 1-5, 1-4, 1-3, 1-2, 2-5, 2-4, 2-3, 3-5, 3-4, or 4-5 out of the 5 base pairs are C-G base pairs. In certain embodiments, 0, 1, 2, 3, 4, or 5 out of the 5 base pairs are C-G base pairs. In certain embodiments, the targeter stem sequence consists of 5'-GUAGA-3' (SEQ ID NO: 21) and the modulator stem sequence consists of 5'-UCUAC-3'. In certain embodiments, the targeter stem sequence consists of 5'-GUGGG-3' (SEQ ID NO: 22) and the modulator stem sequence consists of 5'-CCCAC-3'.

It is also contemplated that the compatibility of the duplex for a given Cas nuclease may be a factor in providing an operative modified dual guide CRISPR system. For example, the targeter stem sequence and the modulator stem sequence can be derived from a naturally occurring crRNA capable of activating a Cas nuclease in the absence of a tracrRNA. In certain embodiments, the nucleotide sequences of the targeter stem sequence and the modulator stem sequence are identical to the corresponding stem sequences of a stem-loop structure in such naturally occurring crRNA.

In certain embodiments, the targeter nucleic acid comprises, from 5' to 3', a targeter stem sequence and a spacer sequence. The spacer sequence is designed to hybridize with the target nucleotide sequence. To provide sufficient targeting to the target nucleotide sequence, the spacer sequence is generally 16 or more nucleotides in length. In certain embodiments, the spacer sequence is at least 16, 17, 18, 19, 20, 21, 22, 23, 24, 25, 26, 27, 28, 29, 30, 35, 40, 45, 50, or 75 nucleotides in length. In certain embodiments, the spacer sequence is shorter than or equal to 75, 50, 45, 40, 35, 30, 25, or 20 nucleotides in length. Shorter spacer sequence may be desirable for reducing off-target events. Accordingly, in certain embodiments, the spacer sequence is shorter than or equal to 19, 18, or 17 nucleotides. In certain embodiments, the spacer sequence is 17-30 nucleotides in length, e.g., 20-30 nucleotides, 20-25 nucleotides, 20-24 nucleotides, 20-23 nucleotides, 23-25 nucleotides, 20-22 nucleotides, such as 20 or 21 nucleotides in length. In certain embodiments, the spacer sequence is 21 nucleotides in length. In certain embodiments, the spacer sequence is 20 nucleotides in length. In certain embodiments, the spacer sequence is at least 50%, 60%, 70%, 75%, 80%, 85%, 90%, 95%, 96%, 97%, 98%, or 99% complementary to the target nucleotide sequence. In certain embodiments, the spacer sequence is 100% complementary to the target nucleotide sequence in the seed region (5-10 base pairs proximal to the PAM). In certain embodiments, the spacer sequence is 100% complementary to the target nucleotide sequence. It has been reported that compared to DNA binding, DNA cleavage is less tolerant to mismatches between the spacer sequence and the target nucleotide sequence (see, Klein et al. (2018) CELL REPORTS, 22:1413). Accordingly, in specific embodiments, when the engineered, non-naturally occurring system comprises a Cas nuclease, the spacer sequence is 100% complementary to the target nucleotide sequence.

Proper design of the spacer sequence is dependent upon the selection of target nucleotide sequence. For example, to select a target nucleotide sequence in a specific gene in a given genome, sequence analysis can be conducted to minimize potential hybridization of the spacer sequence with any other loci in the genome. The association of the target nucleotide sequence with a PAM recognized by the Cas protein is also considered by many design methods. In a type V-A CRISPR-Cas system, the PAM is immediately upstream from the target nucleotide sequence when using the non-target strand (i.e., the strand not hybridized with the spacer sequence) as the coordinate. Computational models have been developed to assess the targetability of the target nucleotide sequence as well as any potential off-target effect, for example, as disclosed in Doench et al. (2016) NAT. BIOTECHNOL., 34:184; Chuai et al. (2018) GENOME BIOLOGY, 19:80; and Klein et al. (2018) CELL REPORTS, 22:1413. Although computational methods are useful for selection of spacer sequences, it is generally advisable to design multiple spacer sequences and select one or more with high efficiency and specificity based upon the results of in vitro and/or in vivo experiments.

In certain embodiments, the engineered CRISPR-Cas systems (e.g., type V-A CRISPR-Cas systems) provided can be used to target, edit, or otherwise modify specific target nucleotide sequences in human ADORA2A, B2M, CD3E, CD38, CD40LG, CD52, CIITA, CSF2, CTLA4, DCK, FAS, HAVCR2 (also called TIM3), LAG3, PDCD1 (also called PD-1), PTPN6, TIGIT, TRAC, TRBC1, TRBC2, TRBC1_2 (or TRBC1+2), CARD11, CD247, IL7R, LCK, PLCG1, ALPNR, BBS1, CALR, CD3G, CD58, COL17A1, DEFB134, ERAP1, ERAP2, IFNGR1, IFNGR2, JAK1, JAK2, mir-101-2, MLANA, PSMB5, PSMB8, PSMB9, PTCD2, RFX5, RFXANK, RFXAP, RPL23, SOX10, SRP54, STAT1, Tap1, TAP2, TAPBP, TWF1, CD3D, or NLRC5 gene. In particular, the modified guide nucleic acids, such as single guide nucleic acids and dual guide nucleic acids, can be designed to hybridize with the selected target nucleotide sequence and, e.g., activate a Cas nuclease to edit the human genes. CRISPR-Cas systems comprising such guide nucleic acids are also useful for targeting or modifying the human genes.

In certain embodiments of the engineered, non-naturally occurring system, the spacer sequence comprises a nucleotide sequence selected from the group consisting of SEQ ID NOs: 51 and 131-137, wherein the spacer sequence is capable of hybridizing with the human ADORA2A gene. In certain embodiments, when the system is delivered into a population of human cells ex vivo, the genomic sequence at the ADORA2A gene locus is edited in at least 1.5% of the cells.

In certain embodiments of the engineered, non-naturally occurring system, the spacer sequence comprises a nucleotide sequence selected from the group consisting of SEQ ID NOs: 52, 64-66, 138-145, 622, 625-626, and 634-635, wherein the spacer sequence is capable of hybridizing with the human B2M gene. In certain embodiments, when the system is delivered into a population of human cells ex vivo, the genomic sequence at the B2M gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human ADORA2A gene, for example one of the spacer sequences above.

In certain embodiments of the engineered, non-naturally occurring system, the spacer sequence comprises a nucleotide sequence selected from the group consisting of SEQ ID NOs: 724, 726-727, 730-732, 735-738, 741-742, and 744-745, wherein the spacer sequence is capable of hybridizing with the human CD247 gene. In certain embodiments, when the system is delivered into a population of human cells ex vivo, the genomic sequence at the CD247 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CD247 gene, for example one of the spacer sequences above.

In certain embodiments of the engineered, non-naturally occurring system, the spacer sequence comprises a nucleotide sequence selected from the group consisting of SEQ ID NOs: 53 and 146, wherein the spacer sequence is capable of hybridizing with the human CD52 gene. In certain embodiments, when the system is delivered into a population of human cells ex vivo, the genomic sequence at the CD52 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CD52 gene, for example one of the spacer sequences above.

In certain embodiments of the engineered, non-naturally occurring system, the spacer sequence comprises a nucleotide sequence selected from the group consisting of SEQ ID NOs: 54, 147-148, 636-640, 642, 644-648, 650-652, 655-656, 660-663, 666, 668, 670-671, 673-676, 678-679, and 682-685, wherein the spacer sequence is capable of hybridizing with the human CIITA gene. In certain embodiments, when the system is delivered into a population of human cells ex vivo, the genomic sequence at the CIITA gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CIITA gene, for example one of the spacer sequences above.

In certain embodiments of the engineered, non-naturally occurring system, the spacer sequence comprises a nucleotide sequence selected from the group consisting of SEQ ID NOs: 795, 67, 797, 798, 70, and 149-155, wherein the spacer sequence is capable of hybridizing with the human CTLA4 gene. In certain embodiments, when the system is delivered into a population of human cells ex vivo, the genomic sequence at the CTLA4 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CTLA4 gene, for example one of the spacer sequences above.

In certain embodiments of the engineered, non-naturally occurring system, the spacer sequence comprises a nucleotide sequence selected from the group consisting of SEQ ID NOs: 796, 71-74, and 156-159, wherein the spacer sequence is capable of hybridizing with the human DCK gene. In certain embodiments, when the system is delivered into a population of human cells ex vivo, the genomic sequence at the DCK gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human DCK gene, for example one of the spacer sequences above.

In certain embodiments of the engineered, non-naturally occurring system, the spacer sequence comprises a nucleotide sequence selected from the group consisting of SEQ ID NOs: 57, 75-79, and 160-173, wherein the spacer sequence is capable of hybridizing with the human FAS gene. In certain embodiments, when the system is delivered into a population of human cells ex vivo, the genomic sequence at the FAS gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human FAS gene, for example one of the spacer sequences above.

In certain embodiments of the engineered, non-naturally occurring system, the spacer sequence comprises a nucleotide sequence selected from the group consisting of SEQ ID NOs: 58, 80, 799, 800, 83-86, and 174-187, wherein the spacer sequence is capable of hybridizing with the human HAVCR2 gene. In certain embodiments, when the system is delivered into a population of human cells ex vivo, the genomic sequence at the HAVCR2 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human HAVCR2 gene, for example one of the spacer sequences above.

In certain embodiments of the engineered, non-naturally occurring system, the spacer sequence comprises a nucleotide sequence selected from the group consisting of SEQ ID NOs: 748-749 and 753-754, wherein the spacer sequence is capable of hybridizing with the human IL7R gene. In certain embodiments, when the system is delivered into a population of human cells ex vivo, the genomic sequence at the IL7R gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human IL7R gene, for example one of the spacer sequences above.

In certain embodiments of the engineered, non-naturally occurring system, the spacer sequence comprises a nucleotide sequence selected from the group consisting of SEQ ID NOs: 59, 87, 88, and 188-198, wherein the spacer sequence is capable of hybridizing with the human LAG3 gene. In certain embodiments, when the system is delivered into a population of human cells ex vivo, the genomic sequence at the LAG3 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human LAG3 gene, for example one of the spacer sequences above.

In certain embodiments of the engineered, non-naturally occurring system, the spacer sequence comprises the nucleotide sequence of SEQ ID NO: 757, wherein the spacer sequence is capable of hybridizing with the human LCK gene. In certain embodiments, when the system is delivered into a population of human cells ex vivo, the genomic sequence at the LCK gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human LCK gene, for example one of the spacer sequences above.

In certain embodiments of the engineered, non-naturally occurring system, the spacer sequence comprises a nucleotide sequence selected from the group consisting of SEQ ID NOs: 60, 89-92, and 199-201, wherein the spacer sequence is capable of hybridizing with the human PDCD1 gene. In certain embodiments, when the system is delivered into a population of human cells ex vivo, the genomic sequence at the PDCD1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human PDCD1 gene, for example one of the spacer sequences above.

In certain embodiments of the engineered, non-naturally occurring system, the spacer sequence comprises a nucleotide sequence selected from the group consisting of SEQ ID NOs: 759 and 761-762, wherein the spacer sequence is capable of hybridizing with the human PLCG1 gene. In certain embodiments, when the system is delivered into a population of human cells ex vivo, the genomic sequence at the PLCG1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human PLCG1 gene, for example one of the spacer sequences above.

In certain embodiments of the engineered, non-naturally occurring system, the spacer sequence comprises a nucleotide sequence selected from the group consisting of SEQ ID NOs: 61, 93, 801, 802, 96-101, 803, 103, 104, and 202-213, wherein the spacer sequence is capable of hybridizing with the human PTPN6 gene. In certain embodiments, when the system is delivered into a population of human cells ex vivo, the genomic sequence at the PTPN6 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human PTPN6 gene, for example one of the spacer sequences above.

In certain embodiments of the engineered, non-naturally occurring system, the spacer sequence comprises a nucleotide sequence selected from the group consisting of SEQ ID NOs: 62, 105, and 214-217, wherein the spacer sequence is capable of hybridizing with the human TIGIT gene. In certain embodiments, when the system is delivered into a population of human cells ex vivo, the genomic sequence at the TIGIT gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human TIGIT gene, for example one of the spacer sequences above.

In certain embodiments of the engineered, non-naturally occurring system, the spacer sequence comprises a nucleotide sequence selected from the group consisting of SEQ ID NOs: 63, 106, 804, 805, 109-130, and 218-241, wherein the spacer sequence is capable of hybridizing with the human TRAC gene. In certain embodiments, when the system is delivered into a population of human cells ex vivo, the genomic sequence at the TRAC gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human TRAC gene, for example one of the spacer sequences above.

In certain embodiments of the engineered, non-naturally occurring system, the spacer sequence comprises a nucleotide sequence selected from the group consisting of SEQ ID NOs: 705-706, 711-712, 714-715, 717, and 719-720, wherein the spacer sequence is capable of hybridizing with the human TRBC2 gene. In certain embodiments, when the system is delivered into a population of human cells ex vivo, the genomic sequence at the TRBC2 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human TRBC2 gene, for example one of the spacer sequences above.

In certain embodiments, the spacer sequence comprises a nucleotide sequence selected from the group consisting of SEQ ID NOs: 705-706, wherein the spacer sequence is capable of hybridizing with both the human TRBC1 gene and the human TRBC2 gene. In certain embodiments, when the system is delivered into a population of human cells ex vivo, the genomic sequence at the TRBC1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human TRBC1 gene and the human TRBC2 gene, for example one of the spacer sequences above.

In certain embodiments of the engineered, non-naturally occurring system, the spacer sequence comprises a nucleotide sequence selected from the group consisting of SEQ ID NOs: 721-723, wherein the spacer sequence is capable of hybridizing with the human CARD11 gene. In certain embodiments, when the system is delivered into a population of human cells ex vivo, the genomic sequence at the CARD11 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CARD11 gene, for example one of the spacer sequences above.

In certain embodiments of the engineered, non-naturally occurring system, the spacer sequence comprises a nucleotide sequence selected from the group consisting of SEQ ID NOs: 1255-1291, wherein the spacer sequence is capable of hybridizing with the human CD38 gene. In certain embodiments, when the system is delivered into a population of human cells ex vivo, the genomic sequence at the CD38 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CD38 gene, for example one of the spacer sequences above.

In certain embodiments of the engineered, non-naturally occurring system, the spacer sequence comprises a nucleotide sequence selected from the group consisting of SEQ ID NOs: 1213-1254, wherein the spacer sequence is capable of hybridizing with the human CD3E gene. In certain embodiments, when the system is delivered into a population of human cells ex vivo, the genomic sequence at the CD3E gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CD3E gene, for example one of the spacer sequences above.

In certain embodiments of the engineered, non-naturally occurring system, the spacer sequence comprises a nucleotide sequence selected from the group consisting of SEQ ID NOs: 1153-1212, wherein the spacer sequence is capable of hybridizing with the human CD40LG gene. In certain embodiments, when the system is delivered into a population of human cells ex vivo, the genomic sequence at the CD40LG gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CD40LG gene, for example one of the spacer sequences above.

In certain embodiments of the engineered, non-naturally occurring system, the spacer sequence comprises a nucleotide sequence selected from the group consisting of SEQ ID NOs: 1100-1152, wherein the spacer sequence is capable of hybridizing with the human CSF2 gene. In certain embodiments, when the system is delivered into a population of human cells ex vivo, the genomic sequence at the CSF2 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CSF2 gene, for example one of the spacer sequences above.

In certain embodiments of the engineered, non-naturally occurring system, the spacer sequence comprises a nucleotide sequence selected from the group consisting of SEQ ID NOs: 1292-1301, wherein the spacer sequence is capable of hybridizing with the human APLNR gene. In certain embodiments, when the system is delivered into a population of human cells ex vivo, the genomic sequence at the APLNR gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human APLNR gene, for example one of the spacer sequences above.

In certain embodiments of the engineered, non-naturally occurring system, the spacer sequence comprises a nucleotide sequence selected from the group consisting of SEQ ID NOs: 1302-1311, wherein the spacer sequence is capable of hybridizing with the human BBS1 gene. In certain embodiments, when the system is delivered into a population of human cells ex vivo, the genomic sequence at the BBS1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human BBS1 gene, for example one of the spacer sequences above.

In certain embodiments of the engineered, non-naturally occurring system, the spacer sequence comprises a nucleotide sequence selected from the group consisting of SEQ ID NOs: 1312-1321, wherein the spacer sequence is capable of hybridizing with the human CALR gene. In certain embodiments, when the system is delivered into a population of human cells ex vivo, the genomic sequence at the CALR gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CALR gene, for example one of the spacer sequences above.

In certain embodiments of the engineered, non-naturally occurring system, the spacer sequence comprises a nucleotide sequence selected from the group consisting of SEQ ID NOs: 1322-1331, wherein the spacer sequence is capable of hybridizing with the human CD3G gene. In certain embodiments, when the system is delivered into a population of human cells ex vivo, the genomic sequence at the CD3G gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CD3G gene, for example one of the spacer sequences above.

In certain embodiments of the engineered, non-naturally occurring system, the spacer sequence comprises a nucleotide sequence selected from the group consisting of SEQ ID NOs: 1332-1341, wherein the spacer sequence is capable of hybridizing with the human CD58 gene. In certain embodiments, when the system is delivered into a population of human cells ex vivo, the genomic sequence at the CD58 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CD58 gene, for example one of the spacer sequences above.

In certain embodiments of the engineered, non-naturally occurring system, the spacer sequence comprises a nucleotide sequence selected from the group consisting of SEQ ID NOs: 1342-1351, wherein the spacer sequence is capable of hybridizing with the human COL17A1 gene. In certain embodiments, when the system is delivered into a population of human cells ex vivo, the genomic sequence at the COL17A1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human COL17A1 gene, for example one of the spacer sequences above.

In certain embodiments of the engineered, non-naturally occurring system, the spacer sequence comprises a nucleotide sequence selected from the group consisting of SEQ ID NOs: 1352-1361, wherein the spacer sequence is capable of hybridizing with the human DEFB 134 gene. In certain embodiments, when the system is delivered into a population of human cells ex vivo, the genomic sequence at the DEFB 134 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human DEFB134 gene, for example one of the spacer sequences above.

In certain embodiments of the engineered, non-naturally occurring system, the spacer sequence comprises a nucleotide sequence selected from the group consisting of SEQ ID NOs: 1362-1371, wherein the spacer sequence is capable of hybridizing with the human ERAP1 gene. In certain embodiments, when the system is delivered into a population of human cells ex vivo, the genomic sequence at the ERAP1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human ERAP1 gene, for example one of the spacer sequences above.

In certain embodiments of the engineered, non-naturally occurring system, the spacer sequence comprises a nucleotide sequence selected from the group consisting of SEQ ID NOs: 1372-1381, wherein the spacer sequence is capable of hybridizing with the human ERAP2 gene. In certain embodiments, when the system is delivered into a population of human cells ex vivo, the genomic sequence at the ERAP2 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human ERAP2 gene, for example one of the spacer sequences above.

In certain embodiments of the engineered, non-naturally occurring system, the spacer sequence comprises a nucleotide sequence selected from the group consisting of SEQ ID NOs: 1382-1391, wherein the spacer sequence is capable of hybridizing with the human IFNGR1 gene. In certain embodiments, when the system is delivered into a population of human cells ex vivo, the genomic sequence at the IFNGR1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human IFNGR1 gene, for example one of the spacer sequences above.

In certain embodiments of the engineered, non-naturally occurring system, the spacer sequence comprises a nucleotide sequence selected from the group consisting of SEQ ID NOs: 1392-1401, wherein the spacer sequence is capable of hybridizing with the human IFNGR2 gene. In certain embodiments, when the system is delivered into a population of human cells ex vivo, the genomic sequence at the IFNGR2 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human IFNGR2 gene, for example one of the spacer sequences above.

In certain embodiments of the engineered, non-naturally occurring system, the spacer sequence comprises a nucleotide sequence selected from the group consisting of SEQ ID NOs: 1402-1411, wherein the spacer sequence is capable of hybridizing with the human JAK1 gene. In certain embodiments, when the system is delivered into a population of human cells ex vivo, the genomic sequence at the JAK1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human JAK1 gene, for example one of the spacer sequences above.

In certain embodiments of the engineered, non-naturally occurring system, the spacer sequence comprises a nucleotide sequence selected from the group consisting of SEQ ID NOs: 1412-1421, wherein the spacer sequence is capable of hybridizing with the human JAK2 gene. In certain embodiments, when the system is delivered into a population of human cells ex vivo, the genomic sequence at the JAK2 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human JAK2 gene, for example one of the spacer sequences above.

In certain embodiments of the engineered, non-naturally occurring system, the spacer sequence comprises a nucleotide sequence selected from the group consisting of SEQ ID NOs: 1422-1424, wherein the spacer sequence is capable of hybridizing with the human mir-101-2 gene. In certain embodiments, when the system is delivered into a population of human cells ex vivo, the genomic sequence at the mir-101-2 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human mir-101-2 gene, for example one of the spacer sequences above.

In certain embodiments of the engineered, non-naturally occurring system, the spacer sequence comprises a nucleotide sequence selected from the group consisting of SEQ ID NOs: 1425-1434, wherein the spacer sequence is capable of hybridizing with the human MLANA gene. In certain embodiments, when the system is delivered into a population of human cells ex vivo, the genomic sequence at the MLANA gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human MLANA gene, for example one of the spacer sequences above.

In certain embodiments of the engineered, non-naturally occurring system, the spacer sequence comprises a nucleotide sequence selected from the group consisting of SEQ ID NOs: 1435-1444, wherein the spacer sequence is capable of hybridizing with the human PSMB5 gene. In certain embodiments, when the system is delivered into a population of human cells ex vivo, the genomic sequence at the PSMB5 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human PSMB5 gene, for example one of the spacer sequences above.

In certain embodiments of the engineered, non-naturally occurring system, the spacer sequence comprises a nucleotide sequence selected from the group consisting of SEQ ID NOs: 1445-1454, wherein the spacer sequence is capable of hybridizing with the human PSMB8 gene. In certain embodiments, when the system is delivered into a population of human cells ex vivo, the genomic sequence at the PSMB8 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human PSMB8 gene, for example one of the spacer sequences above.

In certain embodiments of the engineered, non-naturally occurring system, the spacer sequence comprises a nucleotide sequence selected from the group consisting of SEQ ID NOs: 1455-1464, wherein the spacer sequence is capable of hybridizing with the human PSMB9 gene. In certain embodiments, when the system is delivered into a population of human cells ex vivo, the genomic sequence at the PSMB9 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human PSMB9 gene, for example one of the spacer sequences above.

In certain embodiments of the engineered, non-naturally occurring system, the spacer sequence comprises a nucleotide sequence selected from the group consisting of SEQ ID NOs: 1465-1474, wherein the spacer sequence is capable of hybridizing with the human PTCD2 gene. In certain embodiments, when the system is delivered into a population of human cells ex vivo, the genomic sequence at the PTCD2 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human PTCD2 gene, for example one of the spacer sequences above.

In certain embodiments of the engineered, non-naturally occurring system, the spacer sequence comprises a nucleotide sequence selected from the group consisting of SEQ ID NOs: 1475-1484, wherein the spacer sequence is capable of hybridizing with the human RFX5 gene. In certain embodiments, when the system is delivered into a population of human cells ex vivo, the genomic sequence at the RFX5 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human RFX5 gene, for example one of the spacer sequences above.

In certain embodiments of the engineered, non-naturally occurring system, the spacer sequence comprises a nucleotide sequence selected from the group consisting of SEQ ID NOs: 1485-1494, wherein the spacer sequence is capable of hybridizing with the human RFXANK gene. In certain embodiments, when the system is delivered into a population of human cells ex vivo, the genomic sequence at the RFXANK gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human RFXANK gene, for example one of the spacer sequences above.

In certain embodiments of the engineered, non-naturally occurring system, the spacer sequence comprises a nucleotide sequence selected from the group consisting of SEQ ID NOs: 1495-1504, wherein the spacer sequence is capable of hybridizing with the human RFXAP gene. In certain embodiments, when the system is delivered into a population of human cells ex vivo, the genomic sequence at the RFXAP gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human RFXAP gene, for example one of the spacer sequences above.

In certain embodiments of the engineered, non-naturally occurring system, the spacer sequence comprises a nucleotide sequence selected from the group consisting of SEQ ID NOs: 1505-1514, wherein the spacer sequence is capable of hybridizing with the human RPL23 gene. In certain embodiments, when the system is delivered into a population of human cells ex vivo, the genomic sequence at the RPL23 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human RPL23 gene, for example one of the spacer sequences above.

In certain embodiments of the engineered, non-naturally occurring system, the spacer sequence comprises a nucleotide sequence selected from the group consisting of SEQ ID NOs: 1515-1520, wherein the spacer sequence is capable of hybridizing with the human SOX10 gene. In certain embodiments, when the system is delivered into a population of human cells ex vivo, the genomic sequence at the SOX10 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human SOX10 gene, for example one of the spacer sequences above.

In certain embodiments of the engineered, non-naturally occurring system, the spacer sequence comprises a nucleotide sequence selected from the group consisting of SEQ ID NOs: 1521-1531, wherein the spacer sequence is capable of hybridizing with the human SRP54 gene. In certain embodiments, when the system is delivered into a population of human cells ex vivo, the genomic sequence at the SRP54 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human SRP54 gene, for example one of the spacer sequences above.

In certain embodiments of the engineered, non-naturally occurring system, the spacer sequence comprises a nucleotide sequence selected from the group consisting of SEQ ID NOs: 1532-1541, wherein the spacer sequence is capable of hybridizing with the human STAT1 gene. In certain embodiments, when the system is delivered into a population of human cells ex vivo, the genomic sequence at the STAT1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human STAT1 gene, for example one of the spacer sequences above.

In certain embodiments of the engineered, non-naturally occurring system, the spacer sequence comprises a nucleotide sequence selected from the group consisting of SEQ ID NOs: 1542-1551, wherein the spacer sequence is capable of hybridizing with the human Tap1 gene. In certain embodiments, when the system is delivered into a population of human cells ex vivo, the genomic sequence at the Tap1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human Tap1 gene, for example one of the spacer sequences above.

In certain embodiments of the engineered, non-naturally occurring system, the spacer sequence comprises a nucleotide sequence selected from the group consisting of SEQ ID NOs: 1552-1561, wherein the spacer sequence is capable of hybridizing with the human TAP2 gene. In certain embodiments, when the system is delivered into a population of human cells ex vivo, the genomic sequence at the TAP2 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human TAP2 gene, for example one of the spacer sequences above.

In certain embodiments of the engineered, non-naturally occurring system, the spacer sequence comprises a nucleotide sequence selected from the group consisting of SEQ ID NOs: 1562-1571, wherein the spacer sequence is capable of hybridizing with the human TAPBP gene. In certain embodiments, when the system is delivered into a population of human cells ex vivo, the genomic sequence at the TAPBP gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human TAPBP gene, for example one of the spacer sequences above.

In certain embodiments of the engineered, non-naturally occurring system, the spacer sequence comprises a nucleotide sequence selected from the group consisting of SEQ ID NOs: 1572-1581, wherein the spacer sequence is capable of hybridizing with the human TWF1 gene. In certain embodiments, when the system is delivered into a population of human cells ex vivo, the genomic sequence at the TWF1 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human TWF1 gene, for example one of the spacer sequences above.

In certain embodiments of the engineered, non-naturally occurring system, the spacer sequence comprises a nucleotide sequence selected from the group consisting of SEQ ID NOs: 1582-1591, wherein the spacer sequence is capable of hybridizing with the human CD3D gene. In certain embodiments, when the system is delivered into a population of human cells ex vivo, the genomic sequence at the CD3D gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human CD3D gene, for example one of the spacer sequences above.

In certain embodiments of the engineered, non-naturally occurring system, the spacer sequence comprises a nucleotide sequence selected from the group consisting of SEQ ID NOs: 1592-1610, wherein the spacer sequence is capable of hybridizing with the human NLRC5 gene. In certain embodiments, when the system is delivered into a population of human cells ex vivo, the genomic sequence at the NLRC5 gene locus is edited in at least 1.5% of the cells. In certain embodiments, a modified guide nucleic acid, e.g., modified guide RNA, comprises one or more modifications as described in section IA, for example, one or more modifications as described in section IA1., and a spacer sequence capable of hybridizing with the human NLRC5 gene, for example one of the spacer sequences above.

In certain embodiments of the engineered, non-naturally occurring system, the modulator-targeter complex comprises any one of SEQ ID NOs: 1004 and 1012, 1004 and 1013, 1004 and 1014, 1004 and 1015, 1004 and 1016, 1004 and 1017, 1004 and 1018, 1004 and 1019, 1004 and 1020, 1004 and 1021, 1004 and 1022, 1004 and 1023, 1004 and 1024, 1004 and 1025, 1004 and 1026, 1004 and 1027, 1004 and 1028, 1004 and 1029, 1004 and 1030, 1004 and 1031, 1004 and 1032, 1004 and 1033, 1004 and 1034, 1004 and 1035, 1004 and 1036, 1004 and 1037, 1005 and 1012, 1005 and 1013, 1005 and 1014, 1005 and 1015, 1005 and 1016, 1005 and 1017, 1005 and 1018, 1005 and 1019, 1005 and 1020, 1005 and 1021, 1005 and 1022, 1005 and 1023, 1005 and 1024, 1005 and 1025, 1005 and 1026, 1005 and 1027, 1005 and 1028, 1005 and 1029, 1005 and 1030, 1005 and 1031, 1005 and 1032, 1005 and 1033, 1005 and 1034, 1005 and 1035, 1005 and 1036, 1005 and 1037, 1006 and 1012, 1006 and 1013, 1006 and 1014, 1006 and 1015, 1006 and 1016, 1006 and 1017, 1006 and 1018, 1006 and 1019, 1006 and 1020, 1006 and 1021, 1006 and 1022, 1006 and 1023, 1006 and 1024, 1006 and 1025, 1006 and 1026, 1006 and 1027, 1006 and 1028, 1006 and 1029, 1006 and 1030, 1006 and 1031, 1006 and 1032, 1006 and 1033, 1006 and 1034, 1006 and 1035, 1006 and 1036, 1006 and 1037, 1007 and 1012, 1007 and 1013, 1007 and 1014, 1007 and 1015, 1007 and 1016, 1007 and 1017, 1007 and 1018, 1007 and 1019, 1007 and 1020, 1007 and 1021, 1007 and 1022, 1007 and 1023, 1007 and 1024, 1007 and 1025, 1007 and 1026, 1007 and 1027, 1007 and 1028, 1007 and 1029, 1007 and 1030, 1007 and 1031, 1007 and 1032, 1007 and 1033, 1007 and 1034, 1007 and 1035, 1007 and 1036, or 1007 and 1037 wherein the spacer sequence of the complex is capable of hybridizing with a target nucleotide sequence within a first human gene as referred to herein as "gene 1". Exemplary data for these complexes may be found in Example 2, FIG. 4. In certain embodiments, when the system is delivered into a population of human cells ex vivo, the genomic sequence at the gene 1 locus is edited at least 70% as efficiently as a single crRNA such as with modulator-targeter complexes comprising any one of SEQ ID NOs: 1005 and 1014, 1005 and 1027, 1006 and 1014, or 1006 and 1027. In certain embodiments, when the system is delivered into a population of human cells ex vivo, the genomic sequence at the gene 1 locus is edited at least as efficiently as a single crRNA. In certain embodiments, when the system is delivered into a population of human cells ex vivo, the genomic sequence at the gene 1 locus is edited more efficiently than a single crRNA.

In certain embodiments of the engineered, non-naturally occurring system, the modulator-targeter complex comprises any one of SEQ ID NOs: 1000 and 1012, 1000 and 1013, 1000 and 1014, 1000 and 1015, 1000 and 1016, 1000 and 1017, 1000 and 1018, 1000 and 1019, 1000 and 1020, 1000 and 1021, 1000 and 1022, 1000 and 1023, 1000 and 1024, 1000 and 1025, 1000 and 1026, 1000 and 1027, 1000 and 1028, 1000 and 1029, 1000 and 1030, 1000 and 1031, 1000 and 1032, 1000 and 1033, 1000 and 1034, 1000 and 1035, 1000 and 1036, 1000 and 1037, 1001 and 1012, 1001 and 1013, 1001 and 1014, 1001 and 1015, 1001 and 1016, 1001 and 1017, 1001 and 1018, 1001 and 1019, 1001 and 1020, 1001 and 1021, 1001 and 1022, 1001 and 1023, 1001 and 1024, 1001 and 1025, 1001 and 1026, 1001 and 1027, 1001 and 1028, 1001 and 1029, 1001 and 1030, 1001 and 1031, 1001 and 1032, 1001 and 1033, 1001 and 1034, 1001 and 1035, 1001 and 1036, 1001 and 1037, 1002 and 1012, 1002 and 1013, 1002 and 1014, 1002 and 1015, 1002 and 1016, 1002 and 1017, 1002 and 1018, 1002 and 1019, 1002 and 1020, 1002 and 1021, 1002 and 1022, 1002 and 1023, 1002 and 1024, 1002 and 1025, 1002 and 1026, 1002 and 1027, 1002 and 1028, 1002 and 1029, 1002 and 1030, 1002 and 1031, 1002 and 1032, 1002 and 1033, 1002 and 1034, 1002 and 1035, 1002 and 1036, 1002 and 1037, 1003 and 1012, 1003 and 1013, 1003 and 1014, 1003 and 1015, 1003 and 1016, 1003 and 1017, 1003 and 1018, 1003 and 1019, 1003 and 1020, 1003 and 1021, 1003 and 1022, 1003 and 1023, 1003 and 1024, 1003 and 1025, 1003 and 1026, 1003 and 1027, 1003 and 1028, 1003 and 1029, 1003 and 1030, 1003 and 1031, 1003 and 1032, 1003 and 1033, 1003 and 1034, 1003 and 1035, 1003 and 1036, or 1003 and 1037 wherein the spacer sequence of the complex is capable of hybridizing with a target nucleotide sequence within a second human gene as referred to herein as "gene 2". Exemplary data for these complexes may be found in Example 2, FIG. 5. In certain embodiments, when the system is delivered into a population of human cells ex vivo, the genomic sequence at the gene 2 locus is edited at least 70% as efficiently as a single crRNA such as with modulator-targeter complexes comprising any one of SEQ ID NOs: 1000 and 1012, 1000 and 1012, 1000 and 1013, 1000 and 1016, 1000 and 1017, 1000 and 1018, 1000 and 1019, 1000 and 1020, 1000 and 1025, 1000 and 1025, 1000 and 1025, 1000 and 1025, 1000 and 1026, 1000 and 1031, 1000 and 1032, 1000 and 1033, 1001 and 1012, 1001 and 1012, 1001 and 1018, 1001 and 1019, 1001 and 1025, 1001 and 1025, 1001 and 1026, 1001 and 1032, 1001 and 1033, 1003 and 1013, 1003 and 1014, 1003 and 1025, 1003 and 1025, 1003 and 1025, 1003 and 1027, 1003 and 1032, 1000 and 1014, 1000 and 1027, 1001 and 1014, or 1001 and 1027. In certain embodiments, when the system is delivered into a population of human cells ex vivo, the genomic sequence at the gene 2 locus is edited at least as efficiently as a single crRNA such as with modulator-targeter complexes comprising any one of SEQ ID NOs: 1000 and 1014, 1000 and 1027, 1001 and 1014, or 1001 and 1027. In certain embodiments, when the system is delivered into a population of human cells ex vivo, the genomic sequence at the gene 2 locus is edited more efficiently than a single crRNA such as with modulator-targeter complexes comprising SEQ ID NOs: 1000 and 1014, 1000 and 1027, 1001 and 1014, or 1001 and 1027.

In certain embodiments of the engineered, non-naturally occurring system, the modulator-targeter complex comprises any one of SEQ ID NOs: 1008 and 1012, 1008 and 1013, 1008 and 1014, 1008 and 1015, 1008 and 1016, 1008 and 1017, 1008 and 1018, 1008 and 1019, 1008 and 1020, 1008 and 1021, 1008 and 1022, 1008 and 1023, 1008 and 1024, 1008 and 1025, 1008 and 1026, 1008 and 1027, 1008 and 1028, 1008 and 1029, 1008 and 1030, 1008 and 1031, 1008 and 1032, 1008 and 1033, 1008 and 1034, 1008 and 1035, 1008 and 1036, 1008 and 1037, 1009 and 1012, 1009 and 1013, 1009 and 1014, 1009 and 1015, 1009 and 1016, 1009 and 1017, 1009 and 1018, 1009 and 1019, 1009 and 1020, 1009 and 1021, 1009 and 1022, 1009 and 1023, 1009 and 1024, 1009 and 1025, 1009 and 1026, 1009 and 1027, 1009 and 1028, 1009 and 1029, 1009 and 1030, 1009 and 1031, 1009 and 1032, 1009 and 1033, 1009 and 1034, 1009 and 1035, 1009 and 1036, 1009 and 1037, 1010 and 1012, 1010 and 1013, 1010 and 1014, 1010 and 1015, 1010 and 1016, 1010 and 1017, 1010 and 1018, 1010 and 1019, 1010 and 1020, 1010 and 1021, 1010 and 1022, 1010 and 1023, 1010 and 1024, 1010 and 1025, 1010 and 1026, 1010 and 1027, 1010 and 1028, 1010 and 1029, 1010 and 1030, 1010 and 1031, 1010 and 1032, 1010 and 1033, 1010 and 1034, 1010 and 1035, 1010 and 1036, 1010 and 1037, 1011 and 1012, 1011 and 1013, 1011 and 1014, 1011 and 1015, 1011 and 1016, 1011 and 1017, 1011 and 1018, 1011 and 1019, 1011 and 1020, 1011 and 1021, 1011 and 1022, 1011 and 1023, 1011 and 1024, 1011 and 1025, 1011 and 1026, 1011 and 1027, 1011 and 1028, 1011 and 1029, 1011 and 1030, 1011 and 1031, 1011 and 1032, 1011 and 1033, 1011 and 1034, 1011 and 1035, 1011 and 1036, or 1011 and 1037 wherein the spacer sequence of the complex is capable of hybridizing with a target nucleotide sequence within a third human gene as referred to herein as "gene 3". Exemplary data for these complexes may be found in Example 2, FIG. 6. In certain embodiments, when the system is delivered into a population of human cells ex vivo, the genomic sequence at the gene 3 locus is edited at least 70% as efficiently as a single crRNA such as with modulator-targeter complexes comprising any one of SEQ ID NOs: 1008 and 1012, 1008 and 1013, 1008 and 1014, 1008 and 1016, 1008 and 1017, 1008 and 1023, 1008 and 1024, 1008 and 1026, 1008 and 1027, 1008 and 1029, 1008 and 1030, 1008 and 1032, 1008 and 1033, 1008 and 1034, 1008 and 1035, 1008 and 1037, 1009 and 1012, 1009 and 1013, 1009 and 1014, 1009 and 1016, 1009 and 1017, 1009 and 1018, 1009 and 1019, 1009 and 1020, 1009 and 1021, 1009 and 1022, 1009 and 1023, 1009 and 1024, 1010 and 1012, 1010 and 1013, 1010 and 1014, 1010 and 1016, 1010 and 1017, 1010 and 1018, 1010 and 1020, 1010 and 1021, 1010 and 1022, 1010 and 1023, 1010 and 1024, 1010 and 1027, 1010 and 1030, 1008 and 1021, 1008 and 1031, 1008 and 1018, 1008 and 1019, 1008 and 1020, 1008 and 1022, or 1010 and 1019. In certain embodiments, when the system is delivered into a population of human cells ex vivo, the genomic sequence at the gene 3 locus is edited at least as efficiently as a single crRNA such as with modulator-targeter complexes comprising any one of SEQ ID NOs: 1008 and 1021, 1008 and 1031, 1008 and 1018, 1008 and 1019, 1008 and 1020, 1008 and 1022, or 1010 and 1019. In certain embodiments, when the system is delivered into a population of human cells ex vivo, the genomic sequence at the gene 3 locus is edited more efficiently than a single crRNA such as with modulator-targeter complexes comprising any one of SEQ ID NOs: 1008 and 1018, 1008 and 1019, 1008 and 1020, 1008 and 1022, or 1010 and 1019.

In certain embodiments of the engineered, non-naturally occurring system, genomic mutations are detected in no more than 2% of the cells at any off-target loci by CIRCLE-Seq. In certain embodiments, genomic mutations are detected in no more than 1% of the cells at any off-target loci by CIRCLE-Seq.

In certain embodiments, provided is a guide nucleic acid a modified guide nucleic acid, e.g., modified guide RNA, comprising one or more modifications as described in section IA, for example, one or more modifications as described in section IA1, and comprising a targeter stem sequence and a spacer sequence, wherein the spacer sequence comprises a nucleotide sequence listed Table 1, 2, or 3, or a portion thereof sufficient to hybridize with the corresponding target gene listed in the table. In particular, Table 1 lists the guide nucleic acid that showed the best editing efficiency for each target gene. Table 2 lists the guide nucleic acids that showed at least 10% editing efficiency. Table 3 lists the guide nucleic acids that showed at least 1.5% and lower than 10% editing efficiency.

In certain embodiments, a guide nucleic acid of the present invention is capable of binding the genomic locus of the corresponding target gene in the human genome. In certain embodiments, a guide nucleic acid of the present invention, alone or in combination with a modulator nucleic acid, is capable of directing a Cas protein to the genomic locus of the corresponding target gene in the human genome. In certain embodiments, a guide nucleic acid of the present invention, alone or in combination with a modulator nucleic acid, is capable of directing a Cas nuclease to the genomic locus of the corresponding target gene in the human genome, thereby resulting in cleavage of the genomic DNA at the genomic locus.

TABLE 1

Selected Spacer Sequences Targeting Human Genes

| Target Gene | crRNA | Spacer Sequence | SEQ ID NO |
|---|---|---|---|
| ADORA2A | gADORA2A_12 | AGGATGTGGTCCCCATGAACT | 51 |
| B2M | gB2M_41 | ATAGATCGAGACATGTAAGCA | 635 |
| CARD11 | gCARD11_1 | TAGTACCGCTCCTGGAAGGTT | 721 |
| CD247 | gCD247_12 | CTAGCAGAGAAGGAAGAACCC | 735 |
| CD52 | gCD52_1 | CTCTTCCTCCTACTCACCATC | 53 |
| CIITA | gCIITA_32 | CCTTGGGGCTCTGACAGGTAG | 636 |
| CTLA4 | gCTLA4_4 | AGCGGCACAAGGCTCAGCTGA | 795 |
| DCK | gDCK_6 | CGGAGGCTCCTTACCGATGTT | 796 |

TABLE 1-continued

Selected Spacer Sequences Targeting Human Genes

| Target Gene | crRNA | Spacer Sequence | SEQ ID NO |
|---|---|---|---|
| FAS | gFAS_36 | GTGTTGCTGGTGAGTGTGCAT | 57 |
| HAVCR2 | gTIM3_6 | CTTGTAAGTAGTAGCAGCAGC | 58 |
| IL7R | gIL7R_3 | CAGGGGAGATGGATCCTATCT | 749 |
| LAG3 | gLAG3_6 | GGGTGCATACCTGTCTGGCTG | 59 |
| LCK | gLCK1_3 | ACCCATCAACCCGTAGGGATG | 757 |
| PDCD1 | gPD_23 | TCTGCAGGGACAATAGGAGCC | 60 |
| PLCG1 | gPLCG1_2 | CCTTTCTGCGCTTCGTGGTGT | 759 |
| PTPN6 | gPTPN6_6 | TATGACCTGTATGGAGGGGAG | 61 |
| TIGIT | gTIGIT_2 | AGGCCTTACCTGAGGCGAGGG | 62 |
| TRAC | gTRAC006 | TGAGGGTGAAGGATAGACGCT | 63 |
| TRBC1+2 | gTRBC1+2_3 | CGCTGTCAAGTCCAGTTCTAC | 706 |
| TRBC2 | gTRBC2_12 | CCGGAGGTGAAGCCACAGTCT | 712 |

TABLE 2

Selected Spacer Sequences Targeting Human Genes

| Target Gene | crRNA | Spacer sequence | SEQ ID NO |
|---|---|---|---|
| ADORA2A | gADORA2A_12 | AGGATGTGGTCCCCATGAACT | 51 |
| B2M | gB2M_4 | CTCACGTCATCCAGCAGAGAA | 52 |
| B2M | gB2M_7 | ACTTTCCATTCTCTGCTGGAT | 64 |
| B2M | gB2M_2 | TGGCCTGGAGGCTATCCAGCG | 65 |
| B2M | gB2M_17 | TATCTCTTGTACTACACTGAA | 66 |
| B2M | gB2M_30 | AGTGGGGGTGAATTCAGTGTA | 625 |
| B2M | gB2M_41 | ATAGATCGAGACATGTAAGCA | 635 |
| CIITA | gCIITA_32 | CCTTGGGGCTCTGACAGGTAG | 636 |
| CIITA | gCIITA_33 | ACCTTGGGGCTCTGACAGGTA | 637 |
| CIITA | gCIITA_35 | CTCCCAGAACCCGACACAGAC | 639 |
| CIITA | gCIITA_36 | TGGGCTCAGGTGCTTCCTCAC | 640 |
| CIITA | gCIITA_38 | CTTGTCTGGGCAGCGGAACTG | 642 |
| CIITA | gCIITA_40 | TCAAAGTAGAGCACATAGGAC | 644 |
| CIITA | gCIITA_41 | TGCCCAACTTCTGCTGGCATC | 645 |
| CIITA | gCIITA_43 | TCTGCAGCCTTCCCAGAGGAG | 647 |
| CIITA | gCIITA_44 | TCCAGGCGCATCTGGCCGGAG | 648 |
| CIITA | gCIITA_48 | CTCGGGAGGTCAGGGCAGGTT | 652 |
| CIITA | gCIITA_57 | CAGAAGAAGCTGCTCCGAGGT | 660 |
| CIITA | gCIITA_59 | AGAGCTCAGGGATGACAGAGC | 662 |
| CIITA | gCIITA_60 | TGCCGGGCAGTGTGCCAGCTC | 663 |
| CIITA | gCIITA_63 | GCCACTCAGAGCCAGCCACAG | 666 |

TABLE 2-continued

Selected Spacer Sequences Targeting Human Genes

| Target Gene | crRNA | Spacer sequence | SEQ ID NO |
|---|---|---|---|
| CIITA | gCIITA_65 | GCAGCACGTGGTACAGGAGCT | 668 |
| CIITA | gCIITA_67 | TGGGCACCCGCCTCACGCCTC | 670 |
| CIITA | gCIITA_70 | CCAGGTCTTCCACATCCTTCA | 673 |
| CIITA | gCIITA_71 | AAAGCCAAGTCCCTGAAGGAT | 674 |
| CIITA | gCIITA_72 | GGTCCCGAACAGCAGGGAGCT | 675 |
| CIITA | gCIITA_73 | TTTAGGTCCCGAACAGCAGGG | 676 |
| CIITA | gCIITA_76 | GGGAAAGCCTGGGGGCCTGAG | 679 |
| CIITA | gCIITA_80 | CAAGGACTTCAGCTGGGGGAA | 682 |
| CIITA | gCIITA_81 | TAGGCACCCAGGTCAGTGATG | 683 |
| CIITA | gCIITA_82 | CGACAGCTTGTACAATAACTG | 684 |
| CD247 | gCD247_1 | TGTGTTGCAGTTCAGCAGGAG | 724 |
| CD247 | gCD247_3 | CGGAGGGTCTACGGCGAGGCT | 726 |
| CD247 | gCD247_4 | TTATCTGTTATAGGAGCTCAA | 727 |
| CD247 | gCD247_8 | GACAAGAGACGTGGCCGGGAC | 731 |
| CD247 | gCD247_12 | CTAGCAGAGAAGGAAGAACCC | 735 |
| CD247 | gCD247_15 | ATCCCAATCTCACTGTAGGCC | 738 |
| CD247 | gCD247_18 | TCATTTCACTCCCAAACAACC | 741 |
| CD247 | gCD247_19 | ACTCCCAAACAACCAGCGCCG | 742 |
| CD52 | gCD52_1 | CTCTTCCTCCTACTCACCATC | 53 |
| CIITA | gCIITA_4 | TAGGGGCCCCAACTCCATGGT | 54 |
| CTLA4 | gCTLA4_4 | AGCGGCACAAGGCTCAGCTGA | 795 |
| CTLA4 | gCTLA4_14 | CCTGGAGATGCATACTCACAC | 67 |
| CTLA4 | gCTLA4_6 | CAGAAGACAGGGATGAAGAGA | 797 |
| CTLA4 | gCTLA4_19 | CACTGGAGGTGCCCGTGCAGA | 798 |
| CTLA4 | gCTLA4_13 | TGTGTGAGTATGCATCTCCAG | 70 |
| DCK | gDCK_6 | CGGAGGCTCCTTACCGATGTT | 796 |
| DCK | gDCK_2 | TCAGCCAGCTCTGAGGGGACC | 71 |
| DCK | gDCK_8 | CTCACAACAGCTGCAGGGAAG | 72 |
| DCK | gDCK_26 | AGCTTGCCATTCAGAGAGGCA | 73 |
| DCK | gDCK_30 | TACATACCTGTCACTATACAC | 74 |
| FAS | gFAS_36 | GTGTTGCTGGTGAGTGTGCAT | 57 |
| FAS | gFAS_34 | TTTTTCTAGATGTGAACATGG | 75 |
| FAS | gFAS_35 | ATGATTCCATGTTCACATCTA | 76 |
| FAS | gFAS_12 | GTGTAACATACCTGGAGGACA | 77 |
| FAS | gFAS_1 | GGAGGATTGCTCAACAACCAT | 78 |
| FAS | gFAS_59 | TAGGAAACAGTGGCAATAAAT | 79 |
| HAVCR2 | gTIM3_6 | CTTGTAAGTAGTAGCAGCAGC | 58 |

TABLE 2-continued

Selected Spacer Sequences Targeting Human Genes

| Target Gene | crRNA | Spacer sequence | SEQ ID NO |
|---|---|---|---|
| HAVCR2 | gTTM3_29 | CAAGGATGCTTACCACCAGGG | 80 |
| HAVCR2 | gTIM3_6 | TAAGTAGTAGCAGCAGCAGCA | 799 |
| HAVCR2 | gTIM3_32 | TATCAGGGAGGCTCCCCAGTG | 800 |
| HAVCR2 | gTIM3_30 | CCACCAGGGGACATGGCCCAG | 83 |
| HAVCR2 | gTIM3_12 | AATGTGGCAACGTGGTGCTCA | 84 |
| HAVCR2 | gTIM3_25 | TGACATTAGCCAAGGTCACCC | 85 |
| HAVCR2 | gTIM3_18 | CGCAAAGGAGATGTGTCCCTG | 86 |
| IL7R | gIL7R_3 | CAGGGGAGATGGATCCTATCT | 749 |
| IL7R | gIL7R_8 | CATAACACACAGGCCAAGATG | 754 |
| LAG3 | gLAG3_6 | GGGTGCATACCTGTCTGGCTG | 59 |
| LAG3 | gLAG3_38 | TCAGGACCTTGGCTGGAGGCA | 87 |
| LAG3 | gLAG3_33 | GGTCACCTGGATCCCTGGGGA | 88 |
| LCK | gLCK1_3 | ACCCATCAACCCGTAGGGATG | 757 |
| PDCD1 | gPD_23 | TCTGCAGGGACAATAGGAGCC | 60 |
| PDCD1 | gPD_2 | CCTTCCGCTCACCTCCGCCTG | 89 |
| PDCD1 | gPD_8 | GCACGAAGCTCTCCGATGTGT | 90 |
| PDCD1 | gPD_29 | CTAGCGGAATGGGCACCTCAT | 91 |
| PDCD1 | gPD_27 | CAGTGGCGAGAGAAGACCCCG | 92 |
| PTPN6 | gPTPN6_6 | TATGACCTGTATGGAGGGGAG | 61 |
| PTPN6 | gPTPN6_46 | ACTGCCCCCCACCCAGGCCTG | 93 |
| PTPN6 | gPTPN6_7 | CGACTCTGACAGAGCTGGTGG | 801 |
| PTPN6 | gPTPN6_26 | CAGAAGCAGGAGGTGAAGAAC | 802 |
| PTPN6 | gPTPN6_1 | ACCGAGACCTCAGTGGGCTGG | 96 |
| PTPN6 | gPTPN6_37 | TGGGCCCTACTCTGTGACCAA | 97 |
| PTPN6 | gPTPN6_16 | TGTGCTCAGTGACCAGCCCAA | 98 |
| PTPN6 | gPTPN6_25 | CCCACCCACATCTCAGAGTTT | 99 |
| PTPN6 | gPTPN6_12 | TTGTGCGTGAGAGCCTCAGCC | 100 |
| PTPN6 | gPTPN6_22 | AAGAAGACGGGGATTGAGGAG | 101 |
| PTPN6 | gPTPN6_5 | TCCCCTCCATACAGGTCATAG | 803 |
| PTPN6 | gPTPN6_19 | GCTCCCCCCAGGGTGGACGCT | 103 |
| PTPN6 | gPTPN6_14 | GGCTGGTCACTGAGCACAGAA | 104 |
| TIGIT | gTIGIT_2 | AGGCCTTACCTGAGGCGAGGG | 62 |
| TIGIT | gTIGIT_18 | GTCCTCCCTCTAGTGGCTGAG | 105 |
| TRAC | gTRAC006 | TGAGGGTGAAGGATAGACGCT | 63 |
| TRAC | gTRAC073 | GCAGACAGGGAGAAATAAGGA | 106 |
| TRAC | gTRAC017 | CAGGTGAAATTCCTGAGATGT | 804 |
| TRAC | gTRAC059 | GACATCATTGACCAGAGCTCT | 805 |
| TRAC | gTRAC078 | CCAGTCACTAAGTCAGTCTC | 109 |
| TRAC | gTRAC012 | TATGGAGAAGCTCTCATTTCT | 110 |
| TRAC | gTRAC039 | TAAGATGCTATTTCCCGTATA | 111 |
| TRAC | gTRAC067 | CCGTGTCATTCTCTGGACTGC | 112 |
| TRAC | gTRAC079 | ATTCCTCCACTTCAACACCTG | 113 |
| TRAC | gTRAC038 | TACGGGAAATAGCATCTTAGA | 114 |
| TRAC | gTRAC061 | GTGGCAATGGATAAGGCCGAG | 115 |
| TRAC | gTRAC058 | CTTGCTTCAGGAATGGCCAGG | 116 |
| TRAC | gTRAC021 | TAGTTCAAAACCTCTATCAAT | 117 |
| TRAC | gTRAC049 | TCTGTGATATACACATCAGAA | 118 |
| TRAC | gTRAC074 | GGCAGACAGGGAGAAATAAGG | 119 |
| TRAC | gTRAC018 | CTCGATATAAGGCCTTGAGCA | 120 |
| TRAC | gTRAC043 | GAGTCTCTCAGCTGGTACACG | 121 |
| TRAC | gTRAC075 | TGGCAGACAGGGAGAAATAAG | 122 |
| TRAC | gTRAC082 | CCAGCTGACAGATGGGCTCCC | 123 |
| TRAC | gTRAC040 | CCGTATAAAGCATGAGACCGT | 124 |
| TRAC | gTRAC041 | CCCCAACCCAGGCTGGAGTCC | 125 |
| TRAC | gTRAC076 | TTGGCAGACAGGGAGAAATAA | 126 |
| TRAC | gTRAC014 | TCAGAAGAGCCTGGCTAGGAA | 127 |
| TRAC | gTRAC029 | CTCTGCCAGAGTTATATTGCT | 128 |
| TRAC | gTRAC028 | CCATGCCTGCCTTTACTCTGC | 129 |
| TRAC | gTRAC050 | GTCTGTGATATACACATCAGA | 130 |
| TRBC1+2 | gTRBC1+2_1 | AGCCATCAGAAGCAGAGATCT | 705 |
| TRBC1+2 | gTRBC1+2_3 | CGCTGTCAAGTCCAGTTCTAC | 706 |
| TRBC2 | gTRBC2_11 | AGACTGTGGCTTCACCTCCGG | 711 |
| TRBC2 | gTRBC2_12 | CCGGAGGTGAAGCCACAGTCT | 712 |
| TRBC2 | gTRBC2_15 | CTAGGGAAGGCCACCTTGTAT | 715 |
| TRBC2 | gTRBC2_21 | GAGCTAGCCTCTGGAATCCTT | 720 |

TABLE 3

Selected Spacer Sequences Targeting Human Genes

| Target Gene | crRNA | Spacer sequence | SEQ ID NO |
|---|---|---|---|
| ADORA2A | gADORA2A_16 | CGGATCTTCCTGGCGGCGCGA | 131 |
| ADORA2A | gADORA2A_28 | AAGGCAGCTGGCACCAGTGCC | 132 |
| ADORA2A | gADORA2A_2 | TGGTGTCACTGGCGGCGGCCG | 133 |
| ADORA2A | gADORA2A_23 | TTCTGCCCCGACTGCAGCCAC | 134 |
| ADORA2A | gADORA2A_7 | GTGACCGGCACGAGGGCTAAG | 135 |

TABLE 3-continued

Selected Spacer Sequences Targeting Human Genes

| Target Gene | crRNA | Spacer sequence | SEQ ID NO |
|---|---|---|---|
| ADORA2A | gADORA2A_8 | CCATCGGCCTGACTCCCATGC | 136 |
| ADORA2A | gADORA2A_4 | CCATCACCATCAGCACCGGGT | 137 |
| B2M | gB2M_21 | TCACAGCCCAAGATAGTTAAG | 138 |
| B2M | gB2M_8 | CTGAATTGCTATGTGTCTGGG | 139 |
| B2M | gB2M_11 | CTGAAGAATGGAGAGAGAATT | 140 |
| B2M | gB2M_18 | TCAGTGGGGGTGAATTCAGTG | 141 |
| B2M | gB2M_5 | CATTCTCTGCTGGATGACGTG | 142 |
| B2M | gB2M_10 | ATCCATCCGACATTGAAGTTG | 143 |
| B2M | gB2M_22 | CCCCACTTAACTATCTTGGGC | 144 |
| B2M | gB2M_1 | GCTGTGCTCGCGCTACTCTCT | 145 |
| B2M | gB2M_27 | AATTCTCTCCATTCTTCAG | 622 |
| B2M | gB2M_31 | CAGTGGGGGTGAATTCAGTGT | 626 |
| B2M | gB2M_40 | CATAGATCGAGACATGTAAGC | 634 |
| CD247 | gCD247_7 | CCCCCATCTCAGGGTCCCGGC | 730 |
| CD247 | gCD247_9 | TCTCCCTCTAACGTCTTCCCG | 732 |
| CD247 | gCD247_13 | TGCAGTTCCTGCAGAAGAGGG | 736 |
| CD247 | gCD247_14 | TGCAGGAACTGCAGAAAGATA | 737 |
| CD247 | gCD247_21 | TGATTTGCTTTCACGCCAGGG | 744 |
| CD247 | gCD247_22 | CTTTCACGCCAGGGTCTCAGT | 745 |
| CD52 | gCD52_4 | GCTGGTGTCGTTTTGTCCTGA | 146 |
| CIITA | gCIITA_18 | TGCTGGCATCTCCATACTCTC | 147 |
| CIITA | gCIITA_29 | GTCTCTTGCAGTGCCTTTCTC | 148 |
| CIITA | gCIITA_34 | CCGGCCTTTTTACCTTGGGGC | 638 |
| CIITA | gCIITA_42 | TGACTTTTCTGCCCAACTTCT | 646 |
| CIITA | gCIITA_46 | CCAGAGCCCATGGGCAGAGT | 650 |
| CIITA | gCIITA_47 | TCCCCACCATCTCCACTCTGC | 651 |
| CIITA | gCIITA_51 | CAGAGCCGGTGGAGCAGTTCT | 655 |
| CIITA | gCIITA_52 | CCCAGCACAGCAATCACTCGT | 656 |
| CIITA | gCIITA_55 | AGCCACATCTTGAAGAGACCT | 658 |
| CIITA | gCIITA_58 | AGCTGTCCGGCTTCTCCATGG | 661 |
| CIITA | gCIITA_68 | CCCCTCTGGATTGGGGAGCCT | 671 |
| CIITA | gCIITA_75 | CCTCCTAGGCTGGGCCCTGTC | 678 |
| CIITA | gCIITA_83 | TCTTGCCAGCGTCCAGTACAA | 685 |
| CTLA4 | gCTLA4_27 | CTGTTGCAGATCCAGAACCGT | 149 |
| CTLA4 | gCTLA4_36 | ACAGCTAAAGAAAAGAAGCCC | 150 |
| CTLA4 | gCTLA4_41 | TCAATTGATGGGAATAAAATA | 151 |
| CTLA4 | gCTLA4_28 | CTCCTCTGGATCCTGCAGCA | 152 |
| CTLA4 | gCTLA4_37 | CACATAGACCCCTGTTGTAAG | 153 |
| CTLA4 | gCTLA4_18 | CTAGATGATTCCATCTGCACG | 154 |
| CTLA4 | gCTLA4_5 | TTCTTCTCTTCATCCCTGTCT | 155 |
| DCK | gDCK_9 | AGGATATTCACAAATGTTGAC | 156 |
| DCK | gDCK_22 | GAAGGTAAAAGACCATCGTTC | 157 |
| DCK | gDCK_21 | TCATACATCATCTGAAGAACA | 158 |
| DCK | gDCK_7 | ATCTTTCCTCACAACAGCTGC | 159 |
| FAS | gFAS_47 | AGTGAAGAGAAAGGAAGTACA | 160 |
| FAS | gFAS_45 | TTTGTTCTTTCAGTGAAGAGA | 161 |
| FAS | gFAS_25 | CTAGGCTTAGAAGTGGAAATA | 162 |
| FAS | gFAS_10 | GAAGGCCTGCATCATGATGGC | 163 |
| FAS | gFAS_32 | GTGCAAGGGTCACAGTGTTCA | 164 |
| FAS | gFAS_5 | GGACGATAATCTAGCAACAGA | 165 |
| FAS | gFAS_14 | TTCCTTGGGCAGGTGAAAGGA | 166 |
| FAS | gFAS_29 | GTTTACATCTGCACTTGGTAT | 167 |
| FAS | gFAS_33 | CTTGGTGCAAGGGTCACAGTG | 168 |
| FAS | gFAS_71 | CTGTTCTGCTGTGTCTTGGAC | 169 |
| FAS | gFAS_38 | CTCTTTGCACTTGGTGTTGCT | 170 |
| FAS | gFAS_70 | TGTTCTGCTGTGTCTTGGACA | 171 |
| FAS | gFAS_4 | ACAGGTTCTTACGTCTGTTGC | 172 |
| FAS | gFAS_15 | GGCAGGTGAAAGGAAAGCTAG | 173 |
| HAVCR2 | gTIM3_42 | CTAGGGTATTCTCATAGCAAA | 174 |
| HAVCR2 | gTIM3_10 | CCCCAGCAGACGGGCACGAGG | 175 |
| HAVCR2 | gTIM3_47 | GCCAACCTCCCTCCCTCAGGA | 176 |
| HAVCR2 | gTIM3_34 | TGTTTCCATAGCAAATATCCA | 177 |
| HAVCR2 | gTIM3_19 | GATCCGGCAGCAGTAGATCCC | 178 |
| HAVCR2 | gTIM3_48 | CCAATCCTGAGGGAGGGAGGT | 179 |
| HAVCR2 | gTIM3_36 | CGGGACTCTGGAGCAACCATC | 180 |
| HAVCR2 | gTIM3_15 | GCCAGTATCTGGATGTCCAAT | 181 |
| HAVCR2 | gTIM3_27 | ACTGCAGCCTTTCCAAGGATG | 182 |
| HAVCR2 | gTIM3_41 | CCCCTTACTAGGGTATTCTCA | 183 |
| HAVCR2 | gTIM3_23 | ACCTGAAGTTGGTCATCAAAC | 184 |
| HAVCR2 | gTIM3_28 | CCAAGGATGCTTACCACCAGG | 185 |
| HAVCR2 | gTIM3_40 | GTTTCCCCCTTACTAGGGTAT | 186 |
| HAVCR2 | gTIM3_13 | ATCAGTCCTGAGCACCACGTT | 187 |
| IL7R | gIL7R_2 | CCAGGGGAGATGGATCCTATC | 748 |
| IL7R | gIL7R_7 | TCTGTCGCTCTGTTGGTCATC | 753 |

TABLE 3-continued

Selected Spacer Sequences Targeting Human Genes

| Target Gene | crRNA | Spacer sequence | SEQ ID NO |
|---|---|---|---|
| LAG3 | gLAG3_35 | TGAGGTGACTCCAGTATCTGG | 188 |
| LAG3 | gLAG3_41 | CCAGCCTTGGCAATGCCAGCT | 189 |
| LAG3 | gLAG3_37 | TGTGGAGCTCTCTGGACACCC | 190 |
| LAG3 | gLAG3_16 | GGGCAGGAAGAGGAAGCTTTC | 191 |
| LAG3 | gLAG3_46 | TCCATAGGTGCCCAACGCTCT | 192 |
| LAG3 | gLAG3_27 | CCACCTGAGGCTGACCTGTGA | 193 |
| LAG3 | gLAG3_31 | CCCAGGGATCCAGGTGACCCA | 194 |
| LAG3 | gLAG3_3 | ACCTGGAGCCACCCAAAGCGG | 195 |
| LAG3 | gLAG3_25 | CCCTTCGACTAGAGGATGTGA | 196 |
| LAG3 | gLAG3_13 | CGCTAAGTGGTGATGGGGGGA | 197 |
| LAG3 | gLAG3_22 | GCAGTGAGGAAAGACCGGGTC | 198 |
| PDCD1 | gPD_20 | CAGAGAGAAGGGCAGAAGTGC | 199 |
| PDCD1 | gPD_22 | GAACTGGCCGGCTGGCCTGGG | 200 |
| PDCD1 | gPD_18 | GTGCCCTTCCAGAGAGAAGGG | 201 |
| PLCG1 | gPLCG1_2 | CCTTTCTGCGCTTCGTGGTGT | 759 |
| PLCG1 | gPLCG1_4 | TGCGCTTCGTGGTGTATGAGG | 761 |
| PLCG1 | gPLCG1_5 | GTGGTGTATGAGGAAGACATG | 762 |
| PTPN6 | gPTPN6_20 | GAGACCTTCGACAGCCTCACG | 202 |
| PTPN6 | gPTPN6_41 | CTGGACCAGATCAACCAGCGG | 203 |
| PTPN6 | gPTPN6_53 | CCCCCCTGCACCCGGCTGCAG | 204 |
| PTPN6 | gPTPN6_28 | CACCAGCGTCTGGAAGGGCAG | 205 |
| PTPN6 | gPTPN6_42 | CTGCCGCTGGTTGATCTGGTC | 206 |
| PTPN6 | gPTPN6_32 | TGGCAGATGGCGTGGCAGGAG | 207 |
| PTPN6 | gPTPN6_4 | CTGGCTCGGCCCAGTCGCAAG | 208 |
| PTPN6 | gPTPN6_8 | AGGTGGATGATGGTGCCGTCG | 209 |
| PTPN6 | gPTPN6_40 | GGGAGACCTGATTCGGGAGAT | 210 |
| PTPN6 | gPTPN6_48 | AATGAACTGGGCGATGGCCAC | 211 |
| PTPN6 | gPTPN6_10 | TCTAGGTGGTACCATGGCCAC | 212 |
| PTPN6 | gPTPN6_39 | CAGGTCTCCCCGCTGGACAAT | 213 |
| TIGIT | gTIGIT_11 | GGGTGGCACATCTCCCCATCC | 214 |
| TIGIT | gTIGIT_7 | TGCAGAGAAAGGTGGCTCTAT | 215 |
| TIGIT | gTIGIT_10 | TAATGCTGACTTGGGGTGGCA | 216 |
| TIGIT | gTIGIT_27 | CTCCTGAGGTCACCTTCCACA | 217 |
| TRAC | gTRAC066 | CTAAGAAACAGTGAGCCTTGT | 218 |
| TRAC | gTRAC042 | CCTCTTTGCCCCAACCCAGGC | 219 |
| TRAC | gTRAC035 | AGGTTTCCTTGAGTGGCAGGC | 220 |
| TRAC | gTRAC044 | AGAATCAAAATCGGTGAATAG | 221 |

TABLE 3-continued

Selected Spacer Sequences Targeting Human Genes

| Target Gene | crRNA | Spacer sequence | SEQ ID NO |
|---|---|---|---|
| TRAC | gTRAC072 | CCCCTTACTGCTCTTCTAGGC | 222 |
| TRAC | gTRAC062 | GGTGGCAATGGATAAGGCCGA | 223 |
| TRAC | gTRAC020 | GAACTATAAATCAGAACACCT | 224 |
| TRAC | gTRAC013 | TTTCTCAGAAGAGCCTGGCTA | 225 |
| TRAC | gTRAC068 | CCCGTGTCATTCTCTGGACTG | 226 |
| TRAC | gTRAC025 | CTGGGCCTTTTTCCCATGCCT | 227 |
| TRAC | gTRAC019 | AACTATAAATCAGAACACCTG | 228 |
| TRAC | gTRAC048 | ATTCTCAAACAAATGTGTCAC | 229 |
| TRAC | gTRAC036 | CTTGAGTGGCAGGCCAGGCCT | 230 |
| TRAC | gTRAC056 | CATGTGCAAACGCCTTCAACA | 231 |
| TRAC | gTRAC064 | TACTAAGAAACAGTGAGCCTT | 232 |
| TRAC | gTRAC071 | CTCAGACTGTTTGCCCCTTAC | 233 |
| TRAC | gTRAC081 | TAATTCCTCCACTTCAACACC | 234 |
| TRAC | gTRAC030 | ATAGGATCTTCTTCAAAACCC | 235 |
| TRAC | gTRAC033 | GAAGAAGATCCTATTAAATAA | 236 |
| TRAC | gTRAC001 | TGTTTTTAATGTGACTCTCAT | 237 |
| TRAC | gTRAC009 | GTACTTTACAGTTTATTAAAT | 238 |
| TRAC | gTRAC007 | ATAAACTGTAAAGTACCAAAC | 239 |
| TRAC | gTRAC084 | GACTTTTCCCAGCTGACAGAT | 240 |
| TRAC | gTRAC083 | CCCAGCTGACAGATGGGCTCC | 241 |
| TRBC2 | gTRBC2_14 | CCAGCAAGGGGTCCTGTCTGC | 714 |
| TRBC2 | gTRBC2_17 | CCATGGCCATCAGCACGAGGG | 717 |
| TRBC2 | gTRBC2_19 | CACAGGTCAAGAGAAAGGATT | 719 |
| CSF2 | gCSF2_001 | TGAGATGACTTCTACTGTTTC | 1100 |
| CSF2 | gCSF2_002 | CCTTTTCTACAGAATGAAACA | 1101 |
| CSF2 | gCSF2_003 | CTTTTCTACAGAATGAAACAG | 1102 |
| CSF2 | gCSF2_04 | CTACAGAATGAAACAGTAGAA | 1103 |
| CSF2 | gCSF2_005 | TACAGAATGAAACAGTAGAAG | 1104 |
| CSF2 | gCSF2_006 | CCACAGGAGCCGACCTGCCTA | 1105 |
| CSF2 | gCSF2_007 | CACAGGAGCCGACCTGCCTAC | 1106 |
| CSF2 | gCSF2_008 | ttattttctttttttAAAGG | 1107 |
| CSF2 | gCSF2_009 | tattttctttttttAAAGGA | 1108 |
| CSF2 | gCSF2_010 | attttctttttttAAAGGAA | 1109 |
| CSF2 | gCSF2_011 | ttttctttttttAAAGGAAA | 1110 |
| CSF2 | gCSF2_012 | tctttttttAAAGGAAACTTC | 1111 |
| CSF2 | gCSF2_013 | ctttttttAAAGGAAACTTCC | 1112 |
| CSF2 | gCSF2_014 | tttttttAAAGGAAACTTCCT | 1113 |

TABLE 3-continued

Selected Spacer Sequences Targeting Human Genes

| Target Gene | crRNA | Spacer sequence | SEQ ID NO |
|---|---|---|---|
| CSF2 | gCSF2_015 | tttAAAGGAAACTTCCTGTGC | 1114 |
| CSF2 | gCSF2_016 | ttAAAGGAAACTTCCTGTGCA | 1115 |
| CSF2 | gCSF2_017 | tAAAGGAAACTTCCTGTGCAA | 1116 |
| CSF2 | gCSF2_018 | AAAGGTGATAATCTGGGTTGC | 1117 |
| CSF2 | gCSF2_019 | AAAGGAAACTTCCTGTGCAAC | 1118 |
| CSF2 | gCSF2_020 | AAGGAAACTTCCTGTGCAACC | 1119 |
| CSF2 | gCSF2_021 | AAACTTTCAAAGGTGATAATC | 1120 |
| CSF2 | gCSF2_022 | AAAGTTTCAAAGAGAACCTGA | 1121 |
| CSF2 | gCSF2_023 | AAAGAGAACCTGAAGGACTTT | 1122 |
| CSF2 | gCSF2_024 | TGCTTGTCATCCCCTTTGACT | 1123 |
| CSF2 | gCSF2_025 | ACTGCTGGGAGCCAGTCCAGG | 1124 |
| CSF2 | gCSF2_026 | CCTAGGTGGTCAGGCTTGGGG | 1125 |
| CSF2 | gCSF2_027 | TGGTCACCATTAATCATTTCC | 1126 |
| CSF2 | gCSF2_028 | CTCTGTGTATTTAAGAGCTCT | 1127 |
| CSF2 | gCSF2_029 | AGAGCTCTTTTGCCAGTGAGC | 1128 |
| CSF2 | gCSF2_030 | ATTCTGTAGAAAAGGAAAATG | 1129 |
| CSF2 | gCSF2_031 | ACCTCCAGGTAAGATGCTTCT | 1130 |
| CSF2 | gCSF2_032 | CAGAAGCCCTGCCCTGGGGT | 1131 |
| CSF2 | gCSF2_033 | GATGGCACCACACAGGGTTGT | 1132 |
| CSF2 | gCSF2_034 | TCTCCAGTCAGCTGGCTGCAG | 1133 |
| CSF2 | gCSF2_035 | TCAGCTGAGCGGCCATGGGCA | 1134 |
| CSF2 | gCSF2_036 | CCACCTGTCCCCTGGTGACTC | 1135 |
| CSF2 | gCSF2_037 | GGGCGCTCACTGTGCCCCGAG | 1136 |
| CSF2 | gCSF2_038 | AGGAACAACCCTTGCCCACCC | 1137 |
| CSF2 | gCSF2_039 | CTGCTGCCCCCAGCCCCAGG | 1138 |
| CSF2 | gCSF2_040 | TGTGCCAACAGTTATGTAATG | 1139 |
| CSF2 | gCSF2_041 | ATCCCAAGGAGTCAGAGCCAC | 1140 |
| CSF2 | gCSF2_042 | CCCTCACCTCTGACCTCATTA | 1141 |
| CSF2 | gCSF2_043 | CTTGGGTTTGCCCTCACCTCT | 1142 |
| CSF2 | gCSF2_044 | CTCTGGCCCCACATGGGTGC | 1143 |
| CSF2 | gCSF2_045 | CTCCCTTCCCGCAGGAAGGAG | 1144 |
| CSF2 | gCSF2_046 | TGGCCTTGACTCCACTCCTTC | 1145 |
| CSF2 | gCSF2_047 | GTCCCAGGGCAGAGCAGGGCA | 1146 |
| CSF2 | gCSF2_048 | ACTGCCCAGAAGGCCAACCTC | 1147 |
| CSF2 | gCSF2_049 | TCTACTGCCTCTTAGAACTCA | 1148 |
| CSF2 | gCSF2_050 | AAAGGAAACTTCCTGTGCAAt | 1149 |
| CSF2 | gCSF2_051 | AAGGAAACTTCCTGTGCAAtC | 1150 |
| CSF2 | gCSF2_052 | AAAGGTGATAgTCTGGaTTGC | 1151 |
| CSF2 | gCSF2_053 | AAACTTTCAAAGGTGATAgTC | 1152 |
| CD40LG | gCD40LG_001 | GTTGTATGTTTCGATCATGCT | 1153 |
| CD40LG | gCD40LG_002 | AACTTTAACACAGCATGATCG | 1154 |
| CD40LG | gCD40LG_003 | ACACAGCATGATCGAAACATA | 1155 |
| CD40LG | gCD40LG_004 | ATGCTGATGGGCAGTCCAGTG | 1156 |
| CD40LG | gCD40LG_005 | CATGCTGATGGGCAGTCCAGT | 1157 |
| CD40LG | gCD40LG_006 | TATGTATTTACTTACTGTTTT | 1158 |
| CD40LG | gCD40LG_007 | ATGTATTTACTTACTGTTTTT | 1159 |
| CD40LG | gCD40LG_008 | TGTATTTACTTACTGTTTTTC | 1160 |
| CD40LG | gCD40LG_009 | CTTACTGTTTTTCTTATCACC | 1161 |
| CD40LG | gCD40LG_010 | TCTTATCACCCAGATGATTGG | 1162 |
| CD40LG | gCD40LG_011 | CTTATCACCCAGATGATTGGG | 1163 |
| CD40LG | gCD40LG_012 | TTATCACCCAGATGATTGGGT | 1164 |
| CD40LG | gCD40LG_013 | TGCTGTATCTTCATAGAAG | 1165 |
| CD40LG | gCD40LG_014 | GCTGTGTATCTTCATAGAAGG | 1166 |
| CD40LG | gCD40LG_015 | CTGTGTATCTTCATAGAAGGT | 1167 |
| CD40LG | gCD40LG_016 | ATGAATACAAAATCTTCATGA | 1168 |
| CD40LG | gCD40LG_017 | CATGAATACAAAATCTTCATG | 1169 |
| CD40LG | gCD40LG_018 | TCCTGTGTTGCATCTCTGTAT | 1170 |
| CD40LG | gCD40LG_019 | GTATTCATGAAAACGATACAG | 1171 |
| CD40LG | gCD40LG_020 | TATTCATGAAAACGATACAGA | 1172 |
| CD40LG | gCD40LG_021 | ATCTCCTCACAGTTGAGTAAG | 1173 |
| CD40LG | gCD40LG_022 | AATCTCCTCACAGTTGAGTAA | 1174 |
| CD40LG | gCD40LG_023 | CCAGTAATTAAGCTGCTTACC | 1175 |
| CD40LG | gCD40LG_024 | ACCAGTAATTAAGCTGCTTAC | 1176 |
| CD40LG | gCD40LG_025 | AAGGCTTTGTGAAGGTAAGCA | 1177 |
| CD40LG | gCD40LG_026 | TTCGTCTCCTCTTTGTTTAAC | 1178 |
| CD40LG | gCD40LG_027 | TTTCTTCGTCTCCTCTTTGTT | 1179 |
| CD40LG | gCD40LG_028 | CTTTCTTCGTCTCCTCTTTGT | 1180 |
| CD40LG | gCD40LG_029 | AGGATATAATGTTAAACAAAG | 1181 |
| CD40LG | gCD40LG_030 | GGATATAATGTTAAACAAAGA | 1182 |
| CD40LG | gCD40LG_031 | AAAGCTGTTTTCTTTCTTCGT | 1183 |
| CD40LG | gCD40LG_032 | CATTTCAAAGCTGTTTTCTTT | 1184 |
| CD40LG | gCD40LG_033 | GCATTTCAAAGCTGTTTTCTT | 1185 |
| CD40LG | gCD40LG_034 | TGCATTTCAAAGCTGTTTTCT | 1186 |
| CD40LG | gCD40LG_035 | AGGATTCTGATCACCTGAAAT | 1187 |

TABLE 3-continued

Selected Spacer Sequences Targeting Human Genes

| Target Gene | crRNA | Spacer sequence | SEQ ID NO |
|---|---|---|---|
| CD40LG | gCD40LG_036 | TGGTTCCATTTCAGGTGATCA | 1188 |
| CD40LG | gCD40LG_037 | GGTTCCATTTCAGGTGATCAG | 1189 |
| CD40LG | gCD40LG_038 | GTTCCATTTCAGGTGATCAGA | 1190 |
| CD40LG | gCD40LG_039 | AGGTGATCAGAATCCTCAAAT | 1191 |
| CD40LG | gCD40LG_040 | CTGCTGGCCTCACTTATGACA | 1192 |
| CD40LG | gCD40LG_041 | AGCCCACTGTAACACTGTTAC | 1193 |
| CD40LG | gCD40LG_042 | CAGCCCACTGTAACACTGTTA | 1194 |
| CD40LG | gCD40LG_043 | TCAGCCCACTGTAACACTGTT | 1195 |
| CD40LG | gCD40LG_044 | CCTTTCTTTGTAACAGTGTTA | 1196 |
| CD40LG | gCD40LG_045 | TTTGTAACAGTGTTACAGTGG | 1197 |
| CD40LG | gCD40LG_046 | TAACAGTGTTACAGTGGGCTG | 1198 |
| CD40LG | gCD40LG_047 | CAGGGTTACCAAGTTGTTGCT | 1199 |
| CD40LG | gCD40LG_048 | CCAGGGTTACCAAGTTGTTGC | 1200 |
| CD40LG | gCD40LG_049 | CCATTTTCCAGGGTTACCAAG | 1201 |
| CD40LG | gCD40LG_050 | ACGGTCAGCTGTTTCCCATTT | 1202 |
| CD40LG | gCD40LG_051 | AACGGTCAGCTGTTTCCCATT | 1203 |
| CD40LG | gCD40LG_052 | GGCAGAGGCTGGCTATAAATG | 1204 |
| CD40LG | gCD40LG_053 | TAGCCAGCCTCTGCCTAAAGT | 1205 |
| CD40LG | gCD40LG_054 | CAGCTCTGAGTAAGATTCTCT | 1206 |
| CD40LG | gCD40LG_055 | GCGGAACTGTGGGTATTTGCA | 1207 |
| CD40LG | gCD40LG_056 | AATTGCAACCAGGTGCTTCGG | 1208 |
| CD40LG | gCD40LG_057 | TCAATGTGACTGATCCAAGCC | 1209 |
| CD40LG | gCD40LG_058 | AGTAAGCCAAAGGACGTGAAG | 1210 |
| CD40LG | gCD40LG_059 | GCTTACTCAAACTCTGAACAG | 1211 |
| CD40LG | gCD40LG_060 | ACTGCTGGCCTCACTTATGAC | 1212 |
| CD3E | gCD3E_1 | CACTCCATCCTACTCACCTGA | 1213 |
| CD3E | gCD3E_2 | tttttCTTATTTATTTTCTAG | 1214 |
| CD3E | gCD3E_3 | ttttCTTATTTATTTTCTAGT | 1215 |
| CD3E | gCD3E_4 | tttCTTATTTATTTTCTAGTT | 1216 |
| CD3E | gCD3E_5 | ttCTTATTTATTTTCTAGTTG | 1217 |
| CD3E | gCD3E_6 | tCTTATTTATTTTCTAGTTGG | 1218 |
| CD3E | gCD3E_7 | CTTATTTATTTTCTAGTTGGC | 1219 |
| CD3E | gCD3E_8 | TTATTTATTTTCTAGTTGGCG | 1220 |
| CD3E | gCD3E_9 | TTTTCTAGTTGGCGTTTGGGG | 1221 |
| CD3E | gCD3E_10 | CTAGTTGGCGTTTGGGGGCAA | 1222 |
| CD3E | gCD3E_11 | TAGTTGGCGTTTGGGGGCAAG | 1223 |
| CD3E | gCD3E_12 | CTTTTCAGGTAATGAAGAAAT | 1224 |
| CD3E | gCD3E_13 | CAGGTAATGAAGAAATGGGTA | 1225 |
| CD3E | gCD3E_14 | AGGTAATGAAGAAATGGGTAA | 1226 |
| CD3E | gCD3E_15 | CTTTTTTCATTTTCAGGTGGT | 1227 |
| CD3E | gCD3E_16 | TTCATTTTCAGGTGGTATTAC | 1228 |
| CD3E | gCD3E_17 | TCATTTTCAGGTGGTATTACA | 1229 |
| CD3E | gCD3E_18 | CATTTTCAGGTGGTATTACAC | 1230 |
| CD3E | gCD3E_19 | ATTTTCAGGTGGTATTACACA | 1231 |
| CD3E | gCD3E_20 | CAGGTGGTATTACACAGACAC | 1232 |
| CD3E | gCD3E_21 | AGGTGGTATTACACAGACACG | 1233 |
| CD3E | gCD3E_22 | CCTTCTTTCTCCCCAGCATAT | 1234 |
| CD3E | gCD3E_23 | TCCCCAGCATATAAAGTCTCC | 1235 |
| CD3E | gCD3E_24 | AGATCCAGGATACTGAGGGCA | 1236 |
| CD3E | gCD3E_25 | tcatTGTGTTGCCATAGTATT | 1237 |
| CD3E | gCD3E_26 | atcatTGTGTTGCCATAGTAT | 1238 |
| CD3E | gCD3E_27 | tatcatTGTGTTGCCATAGTA | 1239 |
| CD3E | gCD3E_28 | tcatcctcatcaccgcctatg | 1240 |
| CD3E | gCD3E_29 | atcatcctcatcaccgcctat | 1241 |
| CD3E | gCD3E_30 | tatcatcctcatcaccgccta | 1242 |
| CD3E | gCD3E_31 | CTCCAATTCTGAAAATTCCTT | 1243 |
| CD3E | gCD3E_32 | CAGAATTGGAGCAAAGTGGTT | 1244 |
| CD3E | gCD3E_33 | AGAATTGGAGCAAAGTGGTTA | 1245 |
| CD3E | gCD3E_34 | CTTCCTCTGGGGTAGCAGACA | 1246 |
| CD3E | gCD3E_35 | ATCTCTACCTGAGGGCAAGAG | 1247 |
| CD3E | gCD3E_36 | TCTCTACCTGAGGGCAAGAGG | 1248 |
| CD3E | gCD3E_37 | TATTCTTGCTCCAGTAGTAAA | 1249 |
| CD3E | gCD3E_38 | CTAGTGGAGCAAGAATAGAAA | 1250 |
| CD3E | gCD3E_39 | CCTGCCGCCAGCACCCGCTCC | 1251 |
| CD3E | gCD3E_40 | CCCTCCTTCCTCCGCAGGACA | 1252 |
| CD3E | gCD3E_41 | TATCCCACGTTACCTCATAGT | 1253 |
| CD3E | gCD3E_42 | ACCCCCAGCCCATCCGGAAAG | 1254 |
| CD38 | gCD38_001 | TCCCCGGACACCGGGCTGAAC | 1255 |
| CD38 | gCD38_002 | AGTGTACTTGACGCATCGCGC | 1256 |
| CD38 | gCD38_003 | CCGAGACCGTCCTGGCGCGAT | 1257 |
| CD38 | gCD38_004 | GCAGTCTACATGTCTGAGATA | 1258 |
| CD38 | gCD38_005 | TGTGTTTTATCTCAGACATGT | 1259 |
| CD38 | gCD38_006 | TCTCAGACATGTAGACTGCCA | 1260 |
| CD38 | gCD38_007 | AAATAAATGCACCCTTGAAAG | 1261 |

TABLE 3-continued

Selected Spacer Sequences Targeting Human Genes

| Target Gene | crRNA | Spacer sequence | SEQ ID NO |
|---|---|---|---|
| CD38 | gCD38_008 | AAGGGTGCATTTATTTCAAAA | 1262 |
| CD38 | gCD38_009 | TTTCAAAACATCCTTGCAACA | 1263 |
| CD38 | gCD38_010 | AAAACATCCTTGCAACATTAC | 1264 |
| CD38 | gCD38_011 | TTCTGCTCCAAAGAAGAATCT | 1265 |
| CD38 | gCD38_012 | TTCTTCCTTAGATTCTTCTTT | 1266 |
| CD38 | gCD38_013 | GAGCAGAATAAAAGATCTGGC | 1267 |
| CD38 | gCD38_014 | TACAAACTATGTCTTTTAGAA | 1268 |
| CD38 | gCD38_015 | TCCAGTCTGGGCAAGATTGAT | 1269 |
| CD38 | gCD38_016 | GAAATAAACTATCAATCTTGC | 1270 |
| CD38 | gCD38_017 | CAGAATACTGAAACAGGGTTG | 1271 |
| CD38 | gCD38_018 | AGTATTCTGGAAAACGGTTTC | 1272 |
| CD38 | gCD38_019 | ACTACTTGGTACTTACCCTGC | 1273 |
| CD38 | gCD38_020 | AGTTTGCAGAAGCTGCCTGTG | 1274 |
| CD38 | gCD38_021 | CAGAAGCTGCCTGTGATGTGG | 1275 |
| CD38 | gCD38_022 | CTGCGGGATCCATTGAGCATC | 1276 |
| CD38 | gCD38_023 | TCAAAGATTTTAGTGCGGGAT | 1277 |
| CD38 | gCD38_024 | GGGTTCTTTGTTTCTTCTATT | 1278 |
| CD38 | gCD38_025 | TTTCTTCTATTTTAGCACTTT | 1279 |
| CD38 | gCD38_026 | TTCTATTTTAGCACTTTTGGG | 1280 |
| CD38 | gCD38_027 | GCACTTTTGGGAGTGTGGAAG | 1281 |
| CD38 | gCD38_028 | GGAGTGTGGAAGTCCATAATT | 1282 |
| CD38 | gCD38_029 | CAACCAGAGAAGGTTCAGACA | 1283 |
| CD38 | gCD38_030 | TGGTGGGATCCTGGCATAAGT | 1284 |
| CD38 | gCD38_031 | TTCCCCAGAGACTTATGCCAG | 1285 |
| CD38 | gCD38_032 | CTTATAATCGATTCCAGCTCT | 1286 |
| CD38 | gCD38_033 | CTTTTTTGCTTTCTTGTCATA | 1287 |
| CD38 | gCD38_034 | CTTTCTTGTCATAGACCTGAC | 1288 |
| CD38 | gCD38_035 | ACACACTGAAGAAACTTGTCA | 1289 |
| CD38 | gCD38_036 | TTGTCATAGACCTGACAAGTT | 1290 |
| CD38 | gCD38_037 | TTCAGTGTGTGAAAAATCCTG | 1291 |
| ALPNR | gAPLNR_001 | ACAACTACTATGGGCAGACA | 1292 |
| ALPNR | gAPLNR_002 | CAGTCTGTGTACTCACACTCA | 1293 |
| ALPNR | gAPLNR_003 | GGAGCAGCCGGGAGAAGAGGC | 1294 |
| ALPNR | gAPLNR_004 | GGACCTTCTTCTGCAAGCTCA | 1295 |
| ALPNR | gAPLNR_006 | TGGTGCCCTTCACCATCATGC | 1296 |
| ALPNR | gAPLNR_007 | GGCGATGAAGAAGTAACAGGT | 1297 |
| ALPNR | gAPLNR_008 | CCCTGTGCTGGATGCCCTACC | 1298 |
| ALPNR | gAPLNR_009 | ACCTCTTCCTCATGAACATCT | 1299 |
| ALPNR | gAPLNR_010 | GACCCCGCTTCCGCCAGGCC | 1300 |
| ALPNR | gAPLNR_011 | TCGTGCATCTGTTCTCCACCC | 1301 |
| BBS1 | gBBS1_005 | CATGGGATGGGGAATACAAG | 1302 |
| BBS1 | gBBS1_007 | GGTCATCACCAGTGGTCCTTT | 1303 |
| BBS1 | gBBS1_009 | GCCTGGTTCCAAAGGTCTTGT | 1304 |
| BBS1 | gBBS1_015 | ACTTAGCTCCAGCTGCAGAAA | 1305 |
| BBS1 | gBBS1_016 | CAAATGCCTCCATTTCACTTA | 1306 |
| BBS1 | gBBS1_017 | TGCAGCTGGAGCTAAGTGAAA | 1307 |
| BBS1 | gBBS1018 | TAAACCAACACAAGTCCAACT | 1308 |
| BBS1 | gBBS1_028 | CACTGTCCACTTCCCTAGGTG | 1309 |
| BBS1 | gBBS1_032 | CGTGGATCAGACACTGCGAGA | 1310 |
| BBS1 | gBBS1_033 | TCCACCCACCCTCTCCATAGG | 1311 |
| CALR | gCALR_001 | GATTCGATCCAGCGGGAAGTC | 1312 |
| CALR | gCALR_006 | CAGACAAGCCAGGATGCACGC | 1313 |
| CALR | gCALR_011 | ACCGTGAACTGCACCACCAGC | 1314 |
| CALR | gCALR_012 | CTAATAGTTTGGACCAGACAG | 1315 |
| CALR | gCALR_013 | GACCAGACAGACATGCACGGA | 1316 |
| CALR | gCALR_014 | CCACCACCCCCAGGCACACCT | 1317 |
| CALR | gCALR_015 | CACACCTGTAGACACTGATTG | 1318 |
| CALR | gCALR_017 | AAGCATCAGGATCCTTTATCT | 1319 |
| CALR | gCALR_019 | TGGGTGGATCCAAGTGCCCTT | 1320 |
| CALR | gCALR_021 | CTCCAAGTCTCACCTGCCAGA | 1321 |
| CD3G | gCD3G_001 | CCGGAGGACAGAGACTGACAT | 1322 |
| CD3G | gCD3G_004 | GCTTCTGCATCACAAGTCAGA | 1323 |
| CD3G | gCD3G_006 | TCTTCAGTTAGGAAGCCGATC | 1324 |
| CD3G | gCD3G_007 | AAGATGGGAAGATGATCGGCT | 1325 |
| CD3G | gCD3G_008 | CACTGATACATCCCTCGAGGG | 1326 |
| CD3G | gCD3G_011 | GTTCAATGCAGTTCTGACACA | 1327 |
| CD3G | gCD3G_012 | CCTACAGTGTGTCAGAACTGC | 1328 |
| CD3G | gCD3G_017 | CCTCTCGACTGGCGAACTCCA | 1329 |
| CD3G | gCD3G_022 | CTTGAAGGTGGCTGTACTGGT | 1330 |
| CD3G | gCD3G_023 | CAGGTACTTTGGCCCAGTCAA | 1331 |
| CD58 | gCD58_004 | CCAACAAATATATGGTGTTGT | 1332 |
| CD58 | gCD58_005 | AAGGCACATTGCTTGGTACAT | 1333 |
| CD58 | gCD58_010 | AAAGAGGTCCTATGGAAAAAA | 1334 |
| CD58 | gCD58_012 | AAAGATGAGAAAGCTCTGAAT | 1335 |

TABLE 3-continued

Selected Spacer Sequences Targeting Human Genes

| Target Gene | crRNA | Spacer sequence | SEQ ID NO |
|---|---|---|---|
| CD58 | gCD58_018 | GCGATTCCATTTCATACTCAT | 1336 |
| CD58 | gCD58_019 | CAGAGTCTCTTCCATCTCCCA | 1337 |
| CD58 | gCD58_020 | CATTGCTCCATAGGACAATCC | 1338 |
| CD58 | gCD58_023 | AGATGGAAAATGATCTTCCAC | 1339 |
| CD58 | gCD58_028 | TAGGTCATTCAAGACACAGAT | 1340 |
| CD58 | gCD58_033 | GGTATTCTGAAATGTGACAGA | 1341 |
| COL17A1 | gCOL17A1_005 | TAGTTGTCACTGAAACAGTAA | 1342 |
| COL17A1 | gCOL17A1_006 | GCATAGCCATTGCTGGTCCCG | 1343 |
| COL17A1 | gCOL17A1_017 | ACTCCGTCCTCTGGTTGAAGA | 1344 |
| COL17A1 | gCOL17A1_024 | CAGTGTCAGGCACCTACGATG | 1345 |
| COL17A1 | gCOL17A1_047 | CTGTTCCATCATTAGCTTCTT | 1346 |
| COL17A1 | gCOL17A1_054 | AGGTGACATGGGAAGTCCAGG | 1347 |
| COL17A1 | gCOL17A1_065 | CAAGAAGCAGCAAACTGACCT | 1348 |
| COL17A1 | gCOL17A1_070 | GGTGACAAAGGACCAATGGGA | 1349 |
| COL17A1 | gCOL17A1_084 | AGAGGGGTCATCGATGCTCAC | 1350 |
| COL17A1 | gCOL17A1_094 | ATGCCGGCTCTACTGTACCTT | 1351 |
| DEFB134 | gDEFB134_001 | CCTGCCAGCACTGGATCCCAA | 1352 |
| DEFB134 | gDEFB134_004 | CTTTGGGATCCAGTGCTGGCA | 1353 |
| DEFB134 | gDEFB134_007 | CTTCCAGGTATAAATTCATTA | 1354 |
| DEFB134 | gDEFB134_008 | TTGTGCATTTCTGATGATAAT | 1355 |
| DEFB134 | gDEFB134_009 | TAGCATTTCTTGTGCATTTCT | 1356 |
| DEFB134 | gDEFB134_010 | ACTCTCATAGCATTCAAGTCT | 1357 |
| DEFB134 | gDEFB134_011 | ACACAGCACTCCAGCTGAAAC | 1358 |
| DEFB134 | gDEFB134_012 | CTTTGACACAGCACTCCAGCT | 1359 |
| DEFB134 | gDEFB134_013 | AGCTGGAGTGCTGTGTCAAAG | 1360 |
| DEFB134 | gDEFB134_014 | TTATGTCAGGGTGCAGGATTT | 1361 |
| ERAP1 | gERAP1_008 | CATGGATCAAGAGATCATAAT | 1362 |
| ERAP1 | gERAP1_015 | CAAAAGCACCTACAGAACCAA | 1363 |
| ERAP1 | gERAP1_029 | AGTCTGTCAGCAAGATAACCA | 1364 |
| ERAP1 | gERAP1_035 | GGTAGGGGATACGGTATGCTG | 1365 |
| ERAP1 | gERAP1_037 | AGCATACCGTATCCCCTAGCC | 1366 |
| ERAP1 | gERAP1_039 | CATAGCACCAGACTGAAAGTC | 1367 |
| ERAP1 | gERAP1_061 | CCTTATCATAAGAAACATCAT | 1368 |
| ERAP1 | gERAP1_065 | AATGCGTCAGCACTAAGATAC | 1369 |
| ERAP1 | gERAP1_077 | CCCTAATAACCATCACAGTGA | 1370 |
| ERAP1 | gERAP1_078 | CTCTAGGAGCATTACCCAGTG | 1371 |
| ERAP2 | gERAP2_001 | TGTGTGAATTAACCATTGCAG | 1372 |
| ERAP2 | gERAP2_014 | ATGTATCTTGAATCTTCCTCT | 1373 |
| ERAP2 | gERAP2_018 | AGTTACCCTGCTCATGAACAA | 1374 |
| ERAP2 | gERAP2_046 | GAGAGTGGATAGTAGATATCA | 1375 |
| ERAP2 | gERAP2_048 | ATATCTACTATCCACTCTCCA | 1376 |
| ERAP2 | gERAP2_099 | ATGTGGACTCAAATGGTTACT | 1377 |
| ERAP2 | gERAP2_108 | CCTGTCAATCACTGGCTTAAA | 1378 |
| ERAP2 | gERAP2_118 | GAGCAATATGAACTGTCAATG | 1379 |
| ERAP2 | gERAP2_134 | ACTTGGGCTCATATGACATAA | 1380 |
| ERAP2 | gERAP2_261 | TCCTTACCATGTTACTTGTCA | 1381 |
| IFNGR1 | gIFNGR1_004 | TTACAGTGCCTAGACCAACTA | 1382 |
| IFNGR1 | gIFNGR1_006 | CCGTAGAGGTAAAGAACTATG | 1383 |
| IFNGR1 | gIFNGR1_008 | GTGTTAAGAATTCAGAATGGA | 1384 |
| IFNGR1 | gIFNGR1_010 | ATGGATCACCAACATGATCAG | 1385 |
| IFNGR1 | gIFNGR1_012 | ACTCTGACCCAAAGAGAATTT | 1386 |
| IFNGR1 | gIFNGR1_021 | GGGATCATAATCGACTTCCTG | 1387 |
| IFNGR1 | gIFNGR1_025 | AGTTGTAACACCCCACACATG | 1388 |
| IFNGR1 | gIFNGR1_042 | GAGACAAAACCTGAATCAAAA | 1389 |
| IFNGR1 | gIFNGR1_049 | AGTAGTAACCAGTCTGAACCT | 1390 |
| IFNGR1 | gIFNGR1_052 | TGGAGTGATCACTCTCAGAAC | 1391 |
| IFNGR2 | gIFNGR2_001 | TCTGTCCCCCTCAAGACCCTC | 1392 |
| IFNGR2 | gIFNGR2_003 | AACTGCACTTGGTAGACAACA | 1393 |
| IFNGR2 | gIFNGR2_005 | CTTCCCAGCACCGACAGTAAA | 1394 |
| IFNGR2 | gIFNGR2_006 | AATGTCACTCTACGCCTTCGA | 1395 |
| IFNGR2 | gIFNGR2_012 | CGAGTAATGGACATAATAACA | 1396 |
| IFNGR2 | gIFNGR2_015 | AGTTATCCAATGAAATGGAGT | 1397 |
| IFNGR2 | gIFNGR2_017 | ATTGGATAACTTAAAACCCTC | 1398 |
| IFNGR2 | gIFNGR2_021 | GTAGCAAGATATGTTGCTTAA | 1399 |
| IFNGR2 | gIFNGR2_026 | GCCTCCACTGAGCTTCAGCAA | 1400 |
| IFNGR2 | gIFNGR2_031 | ACACTCCACCAAGCATCCCAT | 1401 |
| JAK1 | gJAK1_002 | CTTCCACAACAGTATCTAAAT | 1402 |
| JAK1 | gJAK1_021 | GCTACAAGCGATATATTCCAG | 1403 |
| JAK1 | gJAK1_037 | ATTCGAATGACGGTGGAAACG | 1404 |
| JAK1 | gJAK1_059 | GCATGAAGCTGATGTTATCCG | 1405 |
| JAK1 | gJAK1_074 | GTAGACACATTTCCATGGACC | 1406 |
| JAK1 | gJAK1_075 | CCAGAGCGTGGTTCCAAAGCT | 1407 |
| JAK1 | gJAK1_090 | AGATCAGCTATGTGGTTACCT | 1408 |
| JAK1 | gJAK1_100 | CCTTACAAATCTGAACGGCAT | 1409 |

TABLE 3-continued

Selected Spacer Sequences Targeting Human Genes

| Target Gene | crRNA | Spacer sequence | SEQ ID NO |
|---|---|---|---|
| JAK1 | gJAK1_108 | ACCAAAGCAATTGAAACCGAT | 1410 |
| JAK1 | gJAK1_111 | GATTGCATTAAACATTCTGGA | 1411 |
| JAK2 | gJAK2_009 | GAAGCAGCAATACAGATTTCT | 1412 |
| JAK2 | gJAK2_101 | AAGGCGTACGAAGAGAAGTAG | 1413 |
| JAK2 | gJAK2_118 | AGATATGTATCTAGTGATCCA | 1414 |
| JAK2 | gJAK2_121 | GATCACTAGATACATATCTGA | 1415 |
| JAK2 | gJAK2_126 | GCACATACATTCCCATGAATA | 1416 |
| JAK2 | gJAK2_132 | AATGCATTCAGGTGGTACCCA | 1417 |
| JAK2 | gJAK2_137 | CCACAAAGTGGTACCAAAACT | 1418 |
| JAK2 | gJAK2_175 | AAGATAGTCTCGTAAACTTCC | 1419 |
| JAK2 | gJAK2_187 | GGTTAACCAAAGTCTTGCCAC | 1420 |
| JAK2 | gJAK2_191 | CAGGTATGCTCCAGAATCACT | 1421 |
| mir-101-2 | gmir-101-2_001 | GGTTATCATGGTACCGATGCT | 1422 |
| mir-101-2 | gmir-101-2_002 | AGATATACAGCATCGGTACCA | 1423 |
| mir-101-2 | gmir-101-2_003 | TCAATGTGATGGCACCACCAT | 1424 |
| MLANA | gMLANA_001 | AACTTACTCTTCAGCCGTGGT | 1425 |
| MLANA | gMLANA_002 | TCTATCTCTTGGGCCAGGGCC | 1426 |
| MLANA | gMLANA_003 | GTCTTCTACAATACCAACAGC | 1427 |
| MLANA | gMLANA_004 | CCAACCATCAAGGCTCTGTAT | 1428 |
| MLANA | gMLANA_008 | CATTTCAGGATAAAAGTCTTC | 1429 |
| MLANA | gMLANA_009 | AGGATAAAAGTCTTCATGTTG | 1430 |
| MLANA | gMLANA_010 | CTGTCCCGATGATCAAACCCT | 1431 |
| MLANA | gMLANA_011 | TCTTGAAGAGACACTTTGCTG | 1432 |
| MLANA | gMLANA_012 | ATCATCGGGACAGCAAAGTGT | 1433 |
| MLANA | gMLANA_020 | TCATAAGCAGGTGGAGCATTG | 1434 |
| PSMB5 | gPSMB5_001 | TGCCCACACTAGACATGGCGC | 1435 |
| PSMB5 | gPSMB5_002 | GGACTTGGGGGTCGTGCAGAT | 1436 |
| PSMB5 | gPSMB5_003 | GATTCCTGGCTCTTCTGGGAC | 1437 |
| PSMB5 | gPSMB5_005 | CTCTGATCTTAACAGTTCCGC | 1438 |
| PSMB5 | gPSMB5_006 | GAAGCTCATAGATTCGACATT | 1439 |
| PSMB5 | gPSMB5_007 | GAGGCAGCTGCTACAGAGATG | 1440 |
| PSMB5 | gPSMB5_008 | TACTGATACACCATGTTGGCA | 1441 |
| PSMB5 | gPSMB5_010 | CAGGCCTCTACTACGTGGACA | 1442 |
| PSMB5 | gPSMB5_011 | AGGGGCCACCTTCTCTGTAGG | 1443 |
| PSMB5 | gPSMB5_012 | AGGGGGTAGAGCCACTATACT | 1444 |
| PSMB8 | gPSMB8_001 | TCTATGCGATCTCCAGAGCTC | 1445 |
| PSMB8 | gPSMB8_004 | TCTTATCAGCCCACAGAATTC | 1446 |
| PSMB8 | gPSMB8_005 | TCCGTCCCCACCCAGGGACTG | 1447 |
| PSMB8 | gPSMB8_008 | AGTGTCGGCAGCCTCCAAGCT | 1448 |
| PSMB8 | gPSMB8_010 | ATCTTATAGGGTCCTGGACTC | 1449 |
| PSMB8 | gPSMB8_011 | CTGAGAGCCGAGTCCCATGTT | 1450 |
| PSMB8 | gPSMB8_012 | TCATTTGTCCACAGTGTACCA | 1451 |
| PSMB8 | gPSMB8_013 | ACCCAACCATCTTCCTTCATG | 1452 |
| PSMB8 | gPSMB8_014 | TCCACAGTGTACCACATGAAG | 1453 |
| PSMB8 | gPSMB8_015 | TACTTTCACCCAACCATCTTC | 1454 |
| PSMB9 | gPSMB9_001 | ACGGGGCGTTGTGATGGGTT | 1455 |
| PSMB9 | gPSMB9_002 | CTCACCCTGCAGACACTCGGG | 1456 |
| PSMB9 | gPSMB9_005 | CCTCAGGATAGAACTGGAGGA | 1457 |
| PSMB9 | gPSMB9_007 | TCACCACATTTGCAGCAGCCA | 1458 |
| PSMB9 | gPSMB9_009 | GCTGCTGCAAATGTGGTGAGA | 1459 |
| PSMB9 | gPSMB9_010 | GGAGAAACTCACCTGACCTCC | 1460 |
| PSMB9 | gPSMB9_011 | ACCTGAGGATCCCTTTCCCAG | 1461 |
| PSMB9 | gPSMB9_012 | CCAGGTATATGGAACCCTGGG | 1462 |
| PSMB9 | gPSMB9_014 | TCTATGGTTATGTGGATGCAG | 1463 |
| PSMB9 | gPSMB9_015 | GCAGTTCATTGCCCAAGATGA | 1464 |
| PTCD2 | gPTCD2_005 | ACCACATTATCTGTAAGTAGG | 1465 |
| PTCD2 | gPTCD2_007 | GCTAAAAGATACCTACTTACA | 1466 |
| PTCD2 | gPTCD2_011 | GTGCCAGAAAGATTACATGCA | 1467 |
| PTCD2 | gPTCD2_018 | ATTACCAGGTACCATGCAGAG | 1468 |
| PTCD2 | gPTCD2_026 | TTCTCAGACTCCACATCATTC | 1469 |
| PTCD2 | gPTCD2_032 | ATCTCTATCAATACTTGCAAA | 1470 |
| PTCD2 | gPTCD2_033 | GCAGGTGCTTTGCAAGTATTG | 1471 |
| PTCD2 | gPTCD2_042 | CCTGATTCAGAGCTAATGCCA | 1472 |
| PTCD2 | gPTCD2_043 | GCTGTGGCATTAGCTCTGAAT | 1473 |
| PTCD2 | gPTCD2_064 | ATAGCAACGTGTGAGATTTCC | 1474 |
| RFX5 | gRFX5_008 | TGTAGCTCAGAGCCAAGTACA | 1475 |
| RFX5 | gRFX5_012 | GCAAGATCATCAGAGAGATCT | 1476 |
| RFX5 | gRFX5_013 | ACTTGCATCAGATATTGCTAC | 1477 |
| RFX5 | gRFX5_015 | GTACTTACACTCTCAGAACCC | 1478 |
| RFX5 | gRFX5_016 | AGGATCCGCTCTGCCCAGTCA | 1479 |
| RFX5 | gRFX5_017 | GTACCTCTGCAGAAGAGGACG | 1480 |
| RFX5 | gRFX5_018 | GATGACCGTTCCCGAGGTGCA | 1481 |
| RFX5 | gRFX5_026 | GCTGGTGGAGCCTGCCCACTG | 1482 |
| RFX5 | gRFX5_028 | GCATCACTTGCTGTATCCTCT | 1483 |

TABLE 3-continued

Selected Spacer Sequences Targeting Human Genes

| Target Gene | crRNA | Spacer sequence | SEQ ID NO |
|---|---|---|---|
| RFX5 | gRFX5_038 | GCTTCTGCTGCCCTTGATGAC | 1484 |
| RFXANK | gRFXANK_001 | CCCATGGAGCTTACCCAGCCT | 1485 |
| RFXANK | gRFXANK_002 | CCTGCACCCCTGAGCCTGTGA | 1486 |
| RFXANK | gRFXANK_003 | CCAGCAGGCAGCTCCCTGAAG | 1487 |
| RFXANK | gRFXANK_005 | GAGAGATTGAGACCGTTCGCT | 1488 |
| RFXANK | gRFXANK_006 | CCAGGATGTGGGGGTCGGCAC | 1489 |
| RFXANK | gRFXANK_007 | TCCTGCCCCTACCCACGACAG | 1490 |
| RFXANK | gRFXANK_008 | ACGTGGTTCCCGCGCACAGCG | 1491 |
| RFXANK | gRFXANK_009 | CAGCCCGAGGCGCTGACCTCA | 1492 |
| RFXANK | gRFXANK_010 | CGGTATCCCAGGGCCACGGCA | 1493 |
| RFXANK | gRFXANK_011 | CCTGCCCCATCTCAGTGCAAC | 1494 |
| RFXAP | gRFXAP_001 | GAGGATCTAGAGGACGAGGAG | 1495 |
| RFXAP | gRFXAP_004 | TACTTGTCCTTGTACATCTTG | 1496 |
| RFXAP | gRFXAP_005 | CCGCGCTGCCAGTCGAGGCAG | 1497 |
| RFXAP | gRFXAP_009 | ACAATGGAGAGTATGTTATCT | 1498 |
| RFXAP | gRFXAP_012 | GGGATCGTCCTGCAAGACCTA | 1499 |
| RFXAP | gRFXAP_016 | GAACAAGTGTTAAATCAAAAA | 1500 |
| RFXAP | gRFXAP_020 | TAAGTCGTTACTAAGAAGTCC | 1501 |
| RFXAP | gRFXAP_021 | TGTAAAAATTGCACTACTTCT | 1502 |
| RFXAP | gRFXAP_023 | CAGAAACAGCAACAGCTATTA | 1503 |
| RFXAP | gRFXAP_025 | GAGCAAAGACAACAGCAGTTT | 1504 |
| RPL23 | gRPL23_003 | GCACCAGAGGACCCACCACGT | 1505 |
| RPL23 | gRPL23_004 | TATCCACAGGACGTGGTGGGT | 1506 |
| RPL23 | gRPL23_008 | TAGGAGCCAAAAACCTGTATA | 1507 |
| RPL23 | gRPL23_013 | GTTGTCGAATGACCACTGCTG | 1508 |
| RPL23 | gRPL23_014 | TTCTCTCAGTACATCCAGCAG | 1509 |
| RPL23 | gRPL23_019 | AAGATAATGCAGGAGTCATAG | 1510 |
| RPL23 | gRPL23_021 | CTACCTTTCATCTCGCCTTTA | 1511 |
| RPL23 | gRPL23_025 | ATGCAGGTTCTGCCATTACAG | 1512 |
| RPL23 | gRPL23_026 | CAAATATACTGGAGAATCATG | 1513 |
| RPL23 | gRPL23_027 | CCTTCCCTTTATATCCACAGG | 1514 |
| SOX10 | gSOX10_001 | CTGGCGCCGTTGACGCGCACG | 1515 |
| SOX10 | gSOX10_002 | TTGTGCTGCATACGGAGCCGC | 1516 |
| SOX10 | gSOX10_003 | ATGTGGCTGAGTTGGACCAGT | 1517 |
| SOX10 | gSOX10_004 | GCATCCACACCAGGTGGTGAG | 1518 |
| SOX10 | gSOX10_005 | ACTACTCTGACCATCAGCCCT | 1519 |
| SOX10 | gSOX10_006 | GGGCCGGGACAGTGTCGTATA | 1520 |
| SRP54 | gSRP54_011 | TCTTAGTTGCTTCACTAGTTT | 1521 |
| SRP54 | gSRP54_020 | GTGGGTGTCCATGCCTTAACT | 1522 |
| SRP54 | gSRP54_021 | GCTTGTAGACCCTGGAGTTAA | 1523 |
| SRP54 | gSRP54_024 | CCACTCCCTTGCAATCCAACA | 1524 |
| SRP54 | gSRP54_029 | TCACCCAGCTAGCATATTATT | 1525 |
| SRP54 | gSRP54_030 | ATATGTGCAGACATTGAGA | 1526 |
| SRP54 | gSRP54_064 | ATTGGTACAGGGGAACATATA | 1527 |
| SRP54 | gSRP54_087 | GCACCATCCGTACTGTCTAGT | 1528 |
| SRP54 | gSRP54_090 | GTAAACAACCAGGAAGAATCC | 1529 |
| SRP54 | gSRP54_096 | CCCTCAGGTGGCGACATGTCT | 1530 |
| SRP54 | gSRP54_139 | AGGATAACTAACCAAGATCTG | 1531 |
| STAT1 | gSTAT1_003 | CATGGGAAAACTGTCATCATA | 1532 |
| STAT1 | gSTAT1_005 | TAACCACTGTGCCAGGTACTG | 1533 |
| STAT1 | gSTAT1_009 | ATGACCTCCTGTCACAGCTGG | 1534 |
| STAT1 | gSTAT1_013 | TTCTAACCACTCAAATCTAGG | 1535 |
| STAT1 | gSTAT1_014 | AGGAAGACCCAATCCAGATGT | 1536 |
| STAT1 | gSTAT1_026 | TAGTGTATAGAGCATGAAATC | 1537 |
| STAT1 | gSTAT1_032 | TGATCACTCTTTGCCACACCA | 1538 |
| STAT1 | gSTAT1_102 | CCTGACATCATTCGCAATTAG | 1539 |
| STAT1 | gSTAT1_103 | GATACAGATACTTCAGGGGAT | 1540 |
| STAT1 | gSTAT1_112 | GTCACCCTTCTAGACTTCAGA | 1541 |
| Tap1 | gTap1_011 | GAGTGAAGGTATCGGCTGAGC | 1542 |
| Tap1 | gTap1_012 | AGCCCCAGACCTGGCTATGG | 1543 |
| Tap1 | gTap1_016 | AGGAGAAACCTGTCTGGTTCT | 1544 |
| Tap1 | gTap1_020 | CTTCTGCCCAAGAAGGTGGGA | 1545 |
| Tap1 | gTap1_026 | GGGAAAAGCTGCAAGAAATAA | 1546 |
| Tap1 | gTap1_030 | AGGTATGCTGCTGAAAGTGGG | 1547 |
| Tap1 | gTap1_033 | TCTGAGGAGCCCACAGCCTTC | 1548 |
| Tap1 | gTap1_035 | GGTAGGCAAAGGAGACATCTT | 1549 |
| Tap1 | gTap1_036 | CCTACCCAAACCGCCCAGATG | 1550 |
| Tap1 | gTap1_039 | GAAGAAGTCTTCAAGAAAATA | 1551 |
| TAP2 | gTAP2_004 | GCAGCCCCACAGCCCTCCCA | 1552 |
| TAP2 | gTAP2_008 | AGGTGAGACATTAATCCCTCA | 1553 |
| TAP2 | gTAP2_014 | AAGGAAGCCAGTTACTCATCA | 1554 |
| TAP2 | gTAP2_027 | CAGACCCTGGTATACATATAT | 1555 |
| TAP2 | gTAP2_028 | GCTGTCGGTCCATGTAGGAGA | 1556 |
| TAP2 | gTAP2_029 | TCCTACATGGACCGACAGCCA | 1557 |

TABLE 3-continued

Selected Spacer Sequences Targeting Human Genes

| Target Gene | crRNA | Spacer sequence | SEQ ID NO |
|---|---|---|---|
| TAP2 | gTAP2_030 | ACAACCCCTGCAGAGTGGTG | 1558 |
| TAP2 | gTAP2_037 | ATCCAGCAGCACCTGTCCCC | 1559 |
| TAP2 | gTAP2_038 | AGTTGGGCAGGAGCCTGTGCT | 1560 |
| TAP2 | gTAP2_040 | TAGAAGATACCTGTGTATATT | 1561 |
| TAPBP | gTAPBP_001 | CGCTCGCATCCTCCACGAACC | 1562 |
| TAPBP | gTAPBP_002 | GCAGAGGCGGGGAGAGGCACG | 1563 |
| TAPBP | gTAPBP_003 | CCTACATGCCCCCCACCTCCG | 1564 |
| TAPBP | gTAPBP_004 | GGCTAGAGTGGCGACGCCAGC | 1565 |
| TAPBP | gTAPBP_007 | AGGAGGGCACCTATCTGGCCA | 1566 |
| TAPBP | gTAPBP_010 | GTCCTCTTTCCCCAGAACCCC | 1567 |
| TAPBP | gTAPBP_011 | CCCAGAACCCCCCAAAGTGTC | 1568 |
| TAPBP | gTAPBP_012 | AGGGCCCTCCCTTGAGGACAG | 1569 |
| TAPBP | gTAPBP_013 | CTGTCTGCCTTTCTTCTGCTT | 1570 |
| TAPBP | gTAPBP_016 | CCCACAGCTGTCTACCTGTCC | 1571 |
| TWF1 | gTWF1_005 | CACAGCAAGTGAAGATGTTAA | 1572 |
| TWF1 | gTWF1_012 | ATAGAGCAACTTGTGATTGGA | 1573 |
| TWF1 | gTWF1_015 | CCCCTGTTGGAGGACAAACAA | 1574 |
| TWF1 | gTWF1_018 | ATGTGGCCACCTCCAAATTCC | 1575 |
| TWF1 | gTWF1_020 | GAGGTGGCCACATTAAAGATG | 1576 |
| TWF1 | gTWF1_022 | ATCTGTCGTAGTTCTTCCTCA | 1577 |
| TWF1 | gTWF1_051 | CAGATCGAGATAGACAATGGG | 1578 |
| TWF1 | gTWF1_053 | TGAAGAAGTACATCCCAAGCA | 1579 |
| TWF1 | gTWF1_060 | ATGTGATGACTTTAATCAGTA | 1580 |
| TWF1 | gTWF1_101 | AAATAGGTGGGCTACCTTTCT | 1581 |
| CD3D | gCD3D_001 | TCTCTGGCCTGGTACTGGCTA | 1582 |
| CD3D | gCD3D_002 | CCCTTTAGTGAGCCCCTTCAA | 1583 |
| CD3D | gCD3D_003 | GTGAGCCCCTTCAAGATACCT | 1584 |
| CD3D | gCD3D_004 | TGAATTGCAATACCAGCATCA | 1585 |
| CD3D | gCD3D_005 | CCAGGTCCAGTCTTGTAATGT | 1586 |
| CD3D | gCD3D_006 | TCCTTGTATATATCTGTCCCA | 1587 |
| CD3D | gCD3D_007 | GGAGTCTTCTGCTTTGCTGGA | 1588 |
| CD3D | gCD3D_008 | CTGGACATGAGACTGGAAGGC | 1589 |
| CD3D | gCD3D_009 | TCTTCTCCTCTCTTAGCCCCT | 1590 |
| CD3D | gCD3D_010 | CTCCAAGGTGGCTGTACTGAG | 1591 |
| NLRC5 | gNLRC5_001 | GCTCCTGTAGCGCTGCTGGGC | 1592 |
| NLRC5 | gNLRC5_002 | GGGAAGGCTGGCATGGGCAAG | 1593 |
| NLRC5 | gNLRC5_003 | CAGGCCCTGTTCCTTTTTGAA | 1594 |
| NLRC5 | gNLRC5_004 | AATTCCGCCAGCTCAACTTGA | 1595 |
| NLRC5 | gNLRC5_005 | ATCTGTACCTGAGCCCTGAAT | 1596 |
| NLRC5 | gNLRC5_006 | ATGGGCTAGATGAGGCCCTCC | 1597 |
| NLRC5 | gNLRC5_007 | TCCCATCTCTGCAATGGGACC | 1598 |
| NLRC5 | gNLRC5_008 | ATGGGCCACGGGTGGAAGAAT | 1599 |
| NLRC5 | gNLRC5_009 | TCTGTAACTCCACCAGGGCCC | 1600 |
| NLRC5 | gNLRC5_010 | CATAGAAGATAACCTTCCCTG | 1601 |
| NLRC5 | gNLRC5_011 | GGGCCACTCACAGCCTGCTGA | 1602 |
| NLRC5 | gNLRC5_012 | ACCCACCTCAGCCTGCAGGAG | 1603 |
| NLRC5 | gNLRC5_013 | TTCACCTTGGGGCTGGCCATC | 1604 |
| NLRC5 | gNLRC5_014 | TTGCTGCCCTGCACCTGATGG | 1605 |
| NLRC5 | gNLRC5_015 | GTCCGCTGTACCCAGCGGGAA | 1606 |
| NLRC5 | gNLRC5_016 | GCCCTGTGAGCTTGCGGGTGG | 1607 |
| NLRC5 | gNLRC5_017 | TGCGGTGAGACTGGCCAGCTC | 1608 |
| NLRC5 | gNLRC5_018 | CCACTGACCTGCACCGACCTG | 1609 |
| NLRC5 | gNLRC5_019 | ATGGCTGTCCCCTGGAGCCCC | 1610 |

The spacer sequences provided in Tables 1-3 are designed based upon identification of target nucleotide sequences associated with a PAM in a given target gene locus, and are selected based upon the editing efficiency detected in human cells.

Further exemplary spacer sequences useful in embodiments of the methods and compositions disclosed herein are shown in Tables 4-23.

TABLE 4

Tested crRNAs Targeting Human ADORA2A Gene

| crRNA | Spacer Sequence | SEQ ID NO | % Indel |
|---|---|---|---|
| gADORA2A_1 | GTGGTGTCACTGGCGGCGGCC | 242 | 0.3 |
| gADORA2A_2 | TGGTGTCACTGGCGGCGGCCG | 133 | 3.9 |
| gADORA2A_3 | GCCATCACCATCAGCACCGGG | 243 | 0.5 |
| gADORA2A_4 | CCATCACCATCAGCACCGGGT | 137 | 2.1 |
| gADORA2A_5 | GTCCTGGTCCTCACGCAGAGC | 244 | 0.1 |
| gADORA2A_6 | GCCCTCGTGCCGGTCACCAAG | 245 | 0.9 |
| gADORA2A_7 | GTGACCGGCACGAGGGCTAAG | 135 | 2.8 |
| gADORA2A_8 | CCATCGGCCTGACTCCCATGC | 136 | 2.2 |
| gADORA2A_9 | GCTGACCGCAGTTGTTCCAAC | 246 | 1.1 |
| gADORA2A_10 | GGCTGACCGCAGTTGTTCCAA | 247 | 0.5 |
| gADORA2A_11 | GCCCTCCCCGCAGCCCTGGGA | 248 | 1.3 |
| gADORA2A_12 | AGGATGTGGTCCCCATGAACT | 51 | 18.2 |

TABLE 4-continued

Tested crRNAs Targeting Human ADORA2A Gene

| crRNA | Spacer Sequence | SEQ ID NO | % Indel |
|---|---|---|---|
| gADORA2A_13 | AACTTCTTTGCCTGTGTGCTG | 249 | 0.1 |
| gADORA2A_14 | TTTGCCTGTGTGCTGGTGCCC | 250 | 0.2 |
| gADORA2A_15 | CCTGTGTGCTGGTGCCCCTGC | 251 | 1.1 |
| gADORA2A_16 | CGGATCTTCCTGGCGGCGCGA | 131 | 7.8 |
| gADORA2A_17 | AGCTGTCGTCGCGCCGCCAGG | 252 | 0.1 |
| gADORA2A_18 | TGCAGTGTGGACCGTGCCCGC | 253 | 0.2 |
| gADORA2A_19 | GCAGCATGGACCTCCTTCTGC | 254 | 0.4 |
| gADORA2A_20 | CCCTCTGCTGGCTGCCCCTAC | 255 | 0.6 |
| gADORA2A_21 | ACTTTCTTCTGCCCCGACTGC | 256 | 0.6 |
| gADORA2A_22 | CTTCTGCCCCGACTGCAGCCA | 257 | 1.0 |
| gADORA2A_23 | TTCTGCCCCGACTGCAGCCAC | 134 | 2.8 |
| gADORA2A_24 | ATCTACGCCTACCGTATCCGC | 258 | 0.0 |
| gADORA2A_25 | CGCAAGATCATTCGCAGCCAC | 259 | 0.1 |
| gADORA2A_26 | AAAGGTTCTTGCTGCCTCAGG | 260 | 0.1 |
| gADORA2A_27 | CAAGGCAGCTGGCACCAGTGC | 261 | 0.1 |
| gADORA2A_28 | AAGGCAGCTGGCACCAGTGCC | 132 | 5.8 |
| gADORA2A_29 | AGCTCATGGCTAAGGAGCTCC | 262 | 0.2 |
| gADORA2A_30 | GCCATGAGCTCAAGGGAGTGT | 263 | 0.5 |

TABLE 5

Tested crRNAs Targeting Human B2M Gene

| crRNA Name | Spacer Sequence | SEQ ID NO | % Indel |
|---|---|---|---|
| gB2M_1 | GCTGTGCTCGCGCTACTCTCT | 145 | 1.8 |
| gB2M_2 | TGGCCTGGAGGCTATCCAGCG | 65 | 17.4 |
| gB2M_3 | CCCGATATTCCTCAGGTACTC | 264 | 0.1 |
| gB2M_4 | CTCACGTCATCCAGCAGAGAA | 52 | 74.1 |
| gB2M_5 | CATTCTCTGCTGGATGACGTG | 142 | 2.2 |
| gB2M_6 | CCATTCTCTGCTGGATGACGT | 265 | 1.0 |
| gB2M_7 | ACTTTCCATTCTCTGCTGGAT | 64 | 17.9 |
| gB2M_8 | CTGAATTGCTATGTGTCTGGG | 139 | 3.5 |
| gB2M_9 | AATGTCGGATGGATGAAACCC | 266 | 0.5 |
| gB2M_10 | ATCCATCCGACATTGAAGTTG | 143 | 2.0 |
| gB2M_11 | CTGAAGAATGGAGAGAGAATT | 140 | 3.4 |
| gB2M_12 | TCAATTCTCTCTCCATTCTTC | 267 | 0.7 |
| gB2M_13 | TTCAATTCTCTCTCCATTCTT | 268 | 0.7 |
| gB2M_14 | CTGAAAGACAAGTCTGAATGC | 269 | 0.4 |
| gB2M_15 | TCTTTCAGCAAGGACTGGTCT | 270 | 0.9 |

TABLE 5-continued

Tested crRNAs Targeting Human B2M Gene

| crRNA Name | Spacer Sequence | SEQ ID NO | % Indel |
|---|---|---|---|
| gB2M_16 | AGCAAGGACTGGTCTTTCTAT | 271 | 0.3 |
| gB2M_17 | TATCTCTTGTACTACACTGAA | 66 | 15.3 |
| gB2M_18 | TCAGTGGGGGTGAATTCAGTG | 141 | 3.0 |
| gB2M_19 | ACTATCTTGGGCTGTGACAAA | 272 | 0.1 |
| gB2M_20 | GTCACAGCCCAAGATAGTTAA | 273 | 0.8 |
| gB2M_21 | TCACAGCCCAAGATAGTTAAG | 138 | 5.3 |
| gB2M_22 | CCCCACTTAACTATCTTGGGC | 144 | 2.0 |
| gB2M_23 | CTGGCCTGGAGGCTATCCAGC | 618 | 0.77 |
| gB2M_24 | TCCCGATATTCCTCAGGTACT | 619 | 0.54 |
| gB2M_25 | CCGATATTCCTCAGGTACTCC | 620 | 0.14 |
| gB2M_26 | AGTAAGTCAACTTCAATGTCG | 621 | 0.11 |
| gB2M_27 | AATTCTCTCTCCATTCTTCAG | 622 | 2.70 |
| gB2M_28 | CAATTCTCTCTCCATTCTTCA | 623 | 0.26 |
| gB2M_29 | CAGCAAGGACTGGTCTTTCTA | 624 | 0.19 |
| gB2M_30 | AGTGGGGGTGAATTCAGTGTA | 625 | 91.96 |
| gB2M_31 | CAGTGGGGGTGAATTCAGTGT | 626 | 8.10 |
| gB2M_33 | CTATCTCTTGTACTACACTGA | 627 | 0.21 |
| gB2M_34 | TACTACACTGAATTCACCCCC | 628 | 0.80 |
| gB2M_35 | GGCTGTGACAAAGTCACATGG | 629 | 0.18 |
| gB2M_36 | CAAAAGAATGTAAGACTTACC | 630 | 0.13 |
| gB2M_37 | CCTCCATGATGCTGCTTACAT | 631 | 0.81 |
| gB2M_38 | TTCATAGATCGAGACATGTAA | 632 | 0.18 |
| gB2M_39 | TCATAGATCGAGACATGTAAG | 633 | 0.20 |
| gB2M_40 | CATAGATCGAGACATGTAAGC | 634 | 4.25 |
| gB2M_41 | ATAGATCGAGACATGTAAGCA | 635 | 93.92 |

TABLE 6

Tested crRNAs Targeting Human CD52 Gene

| crRNA_Name | Spacer_Sequence | SEQ ID NO | % Indel |
|---|---|---|---|
| gCD52_1 | CTCTTCCTCCTACTCACCATC | 53 | 28.4 |
| gCD52_2 | TCCTCCTACAGATACAAACTG | 274 | N.D. |
| gCD52_3 | GTCCTGAGAGTCCAGTTTGTA | 275 | N.D. |
| gCD52_4 | GCTGGTGTCGTTTTGTCCTGA | 146 | 4.1 |
| gCD52_5 | TGTTGCTGGATGCTGAGGGC | 276 | 1.1 |
| gCD52_6 | CCTTTTCTTCGTGGCCAATGC | 277 | 0.2 |
| gCD52_7 | TCTTCGTGGCCAATGCCATAA | 278 | 0.2 |
| gCD52_8 | CTTCGTGGCCAATGCCATAAT | 279 | 0.15 |

TABLE 7

Tested crRNAs Targeting Human CIITA Gene

| crRNA | Spacer Sequence | SEQ ID NO | % Indel |
|---|---|---|---|
| gCIITA_1 | GGGCTCTGACAGGTAGGACCC | 280 | 0.5 |
| gCIITA_2 | TACCTTGGGGCTCTGACAGGT | 281 | 0.0 |
| gCIITA_3 | TTACCTTGGGGCTCTGACAGG | 282 | 0.0 |
| gCIITA_4 | TAGGGGCCCCAACTCCATGGT | 54 | 13.5 |
| gCIITA_5 | TTAACAGCGATGCTGACCCCC | 284 | 0.1 |
| gCIITA_6 | TATGACCAGATGGACCTGGCT | 285 | 0.2 |
| gCIITA_7 | TCCTCCCAGAACCCGACACAG | 286 | 0.1 |
| gCIITA_8 | CCTCCCAGAACCCGACACAGA | 287 | 0.1 |
| gCIITA_9 | CATGTCACACAACAGCCTGCT | 288 | 0.1 |
| gCIITA_10 | CTCACCGATATTGGCATAAGC | 289 | 0.1 |
| gCIITA_11 | TCCTTGTCTGGGCAGCGGAAC | 290 | 0.1 |
| gCIITA_12 | CCTTGTCTGGGCAGCGGAACT | 291 | 0.4 |
| gCIITA_13 | TCTGGGCAGCGGAACTGGACC | 292 | 0.1 |
| gCIITA_14 | CTCAGGCCCTCCAGCTGGGAG | 293 | 0.2 |
| gCIITA_15 | CTGAAAATGTCCTTGCTCAGG | 294 | 0.2 |
| gCIITA_16 | TCTCAAAGTAGAGCACATAGG | 295 | 0.1 |
| gCIITA_17 | ATCTGGTCCTATGTGCTCTAC | 296 | 0.2 |
| gCIITA_18 | TGCTGGCATCTCCATACTCTC | 147 | 4.8 |
| gCIITA_19 | CTGCCCAACTTCTGCTGGCAT | 297 | 0.5 |
| gCIITA_20 | TCTGCCCAACTTCTGCTGGCA | 298 | 0.1 |
| gCIITA_21 | CTGACTTTTCTGCCCAACTTC | 299 | 0.1 |
| gCIITA_22 | CTCTGCAGCCTTCCCAGAGGA | 300 | 0.6 |
| gCIITA_23 | CCAGAGGAGCTTCCGGCAGAC | 301 | 0.9 |
| gCIITA_24 | AGGTCTGCCGGAAGCTCCTCT | 302 | 0.1 |
| gCIITA_25 | CAGTGCTTCAGGTCTGCCGGA | 303 | 0.2 |
| gCIITA_26 | CGGCAGACCTGAAGCACTGGA | 304 | 0.3 |
| gCIITA_27 | CTCACAGCTGAGCCCCCCACT | 305 | 0.4 |
| gCIITA_28 | CTCCAGGCGCATCTGGCCGGA | 306 | 0.7 |
| gCIITA_29 | GTCTCTTGCAGTGCCTTTCTC | 148 | 2.4 |
| gCIITA_30 | TCTCTTGCAGTGCCTTTCTCC | 307 | 0.1 |
| gCIITA_31 | CTCCAGTTCCTCGTTGAGCTG | 308 | 0.1 |
| gCIITA_32 | CCTTGGGGCTCTGACAGGTAG | 636 | 93.85 |
| gCIITA_33 | ACCTTGGGGCTCTGACAGGTA | 637 | 11.83 |
| gCIITA_34 | CCGGCCTTTTTACCTTGGGGC | 638 | 2.26 |
| gCIITA_35 | CTCCCAGAACCCGACACAGAC | 639 | 48.70 |
| gCIITA_36 | TGGGCTCAGGTGCTTCCTCAC | 640 | 85.46 |
| gCIITA_37 | CTGGGCTCAGGTGCTTCCTCA | 641 | 0.45 |
| gCIITA_38 | CTTGTCTGGGCAGCGGAACTG | 642 | 38.38 |
| gCIITA_39 | CTCAAAGTAGAGCACATAGGA | 643 | 0.25 |
| gCIITA_40 | TCAAAGTAGAGCACATAGGAC | 644 | 15.68 |
| gCIITA_41 | TGCCCAACTTCTGCTGGCATC | 645 | 46.21 |
| gCIITA_42 | TGACTTTTCTGCCCAACTTCT | 646 | 2.72 |
| gCIITA_43 | TCTGCAGCCTTCCCAGAGGAG | 647 | 55.09 |
| gCIITA_44 | TCCAGGCGCATCTGGCCGGAG | 648 | 39.16 |
| gCIITA_45 | TCCAGTTCCTCGTTGAGCTGC | 649 | 0.22 |
| gCIITA_46 | CCAGAGCCCATGGGCAGAGT | 650 | 1.51 |
| gCIITA_47 | TCCCCACCATCTCCACTCTGC | 651 | 2.05 |
| gCIITA_48 | CTCGGGAGGTCAGGGCAGGTT | 652 | 61.63 |
| gCIITA_49 | GAAGCTTGTTGGAGACCTCTC | 653 | 0.67 |
| gCIITA_50 | GGAAGCTTGTTGGAGACCTCT | 654 | 0.57 |
| gCIITA_51 | CAGAGCCGGTGGAGCAGTTCT | 655 | 8.94 |
| gCIITA_52 | CCCAGCACAGCAATCACTCGT | 656 | 2.63 |
| gCIITA_53 | TCTTCTCTGTCCCCTGCCATT | 657 | 0.28 |
| gCIITA_55 | AGCCACATCTTGAAGAGACCT | 658 | 5.71 |
| gCIITA_56 | CCAGAAGAAGCTGCTCCGAGG | 659 | 0.52 |
| gCIITA_57 | CAGAAGAAGCTGCTCCGAGGT | 660 | 12.02 |
| gCIITA_58 | AGCTGTCCGGCTTCTCCATGG | 661 | 3.25 |
| gCIITA_59 | AGAGCTCAGGGATGACAGAGC | 662 | 16.35 |
| gCIITA_60 | TGCCGGGCAGTGTGCCAGCTC | 663 | 11.98 |
| gCIITA_61 | ATGTCTGCGGCCCAGCTCCCA | 664 | 1.25 |
| gCIITA_62 | GCCATCGCCCAGGTCCTCACG | 665 | 1.29 |
| gCIITA_63 | GCCACTCAGAGCCAGCCACAG | 666 | 35.47 |
| gCIITA_64 | TGGCTGGGCTGATCTTCCAGC | 667 | 0.50 |
| gCIITA_65 | GCAGCACGTGGTACAGGAGCT | 668 | 70.73 |
| gCIITA_66 | CTGGGCACCCGCCTCACGCCT | 669 | 0.31 |
| gCIITA_67 | TGGGCACCCGCCTCACGCCTC | 670 | 12.57 |
| gCIITA_68 | CCCCTCTGGATTGGGGAGCCT | 671 | 4.61 |
| gCIITA_69 | AAAGGCTCGATGGTGAACTTC | 672 | 1.17 |
| gCIITA_70 | CCAGGTCTTCCACATCCTTCA | 673 | 38.98 |
| gCIITA_71 | AAAGCCAAGTCCCTGAAGGAT | 674 | 39.50 |
| gCIITA_72 | GGTCCCGAACAGCAGGGAGCT | 675 | 89.25 |
| gCIITA_73 | TTTAGGTCCCGAACAGCAGGG | 676 | 10.88 |
| gCIITA_74 | CTTACGCAAACTCCAGTTTCT | 677 | 0.79 |
| gCIITA_75 | CCTCCTAGGCTGGGCCCTGTC | 678 | 2.78 |
| gCIITA_76 | GGGAAGCCTGGGGGCCTGAG | 679 | 68.93 |
| gCIITA_77 | CCCAAACTGGTGCGGATCCTC | 680 | 0.57 |

TABLE 7-continued

Tested crRNAs Targeting Human CIITA Gene

| crRNA | Spacer Sequence | SEQ ID NO | % Indel |
|---|---|---|---|
| gCIITA_79 | CTCCCTGCAGCATCTGGAGTG | 681 | 1.12 |
| gCIITA_80 | CAAGGACTTCAGCTGGGGAA | 682 | 87.87 |
| gCIITA_81 | TAGGCACCCAGGTCAGTGATG | 683 | 44.56 |
| gCIITA_82 | CGACAGCTTGTACAATAACTG | 684 | 34.37 |
| gCIITA_83 | TCTTGCCAGCGTCCAGTACAA | 685 | 5.62 |
| gCIITA_84 | CCCGGCCTTTTTACCTTGGGG | 686 | 0.38 |
| gCIITA_85 | CCTCCCAGGCAGCTCACAGTG | 687 | 0.74 |
| gCIITA_87 | TCCAGCCAGGTCCATCTGGTC | 688 | 0.15 |
| gCIITA_88 | TTCTCCAGCCAGGTCCATCTG | 689 | 0.21 |
| gCIITA_89 | ATCACCTTCCATGTCACACAA | 690 | 0.31 |
| gCIITA_90 | TCTGGGCTCAGGTGCTTCCTC | 691 | 0.25 |
| gCIITA_91 | TGCCAATATCGGTGAGGAAGC | 692 | 0.17 |
| gCIITA_92 | CAGGACTCCCAGCTGGAGGGC | 693 | 0.61 |
| gCIITA_93 | TCTGACTTTTCTGCCCAACTT | 694 | 0.21 |
| gCIITA_94 | CAGTGCCTTTCTCCAGTTCCT | 695 | 0.25 |
| gCIITA_95 | GCTGGCCTGGGGCACCTCACC | 696 | 0.59 |
| gCIITA_96 | GCTCCATCAGCCACTGACCTG | 697 | 0.29 |
| gCIITA_97 | CCTGTCATGTTTGCTCGGGAG | 698 | 0.27 |
| gCIITA_98 | TCCATCTCCAGAGCACAAGAC | 699 | 0.23 |
| gCIITA_99 | TTGGAGACCTCTCCAGCTGCC | 700 | 0.99 |
| gCIITA_100 | GCAGAGCCGGTGGAGCAGTTC | 701 | 0.46 |
| gCIITA_101 | CTGCTGCTCCTCTCCAGCCTG | 702 | 0.23 |
| gCIITA_103 | GCAGCCAACAGCACCTCAGCC | 703 | 0.22 |
| gCIITA_104 | GCCCAGCACAGCAATCACTCG | 704 | 0.07 |

TABLE 8

Tested crRNAs Targeting Human CTLA4 Gene

| crRNA | Spacer Sequence | SEQ ID NO | % Indel |
|---|---|---|---|
| gCTLA4_1 | TGCCGCTGAAATCCAAGGCAA | 309 | 1.3 |
| gCTLA4_2 | CCTTGGATTTCAGCGGCACAA | 310 | 0.8 |
| gCTLA4_3 | GATTTCAGCGGCACAAGGCTC | 311 | 0.6 |
| gCTLA4_4 | AGCGGCACAAGGCTCAGCTGA | 795 | 58.4 |
| gCTLA4_5 | TTCTTCTCTTCATCCCTGTCT | 155 | 1.7 |
| gCTLA4_6 | CAGAAGACAGGGATGAAGAGA | 797 | 44.6 |
| gCTLA4_7 | GCAGAAGACAGGGATGAAGAG | 312 | 0.2 |
| gCTLA4_8 | GGCTTTTCCATGCTAGCAATG | 313 | 0.1 |
| gCTLA4_9 | GCTTTTCCATGCTAGCAATGC | 314 | 0.2 |
| gCTLA4_10 | TCCATGCTAGCAATGCACGTG | 315 | 0.1 |
| gCTLA4_11 | CCATGCTAGCAATGCACGTGG | 316 | 0.1 |
| gCTLA4_12 | GTGTGTGAGTATGCATCTCCA | 317 | 0.8 |
| gCTLA4_13 | TGTGTGAGTATGCATCTCCAG | 70 | 12.6 |
| gCTLA4_14 | CCTGGAGATGCATACTCACAC | 67 | 47.4 |
| gCTLA4_15 | GCCTGGAGATGCATACTCACA | 318 | 0.2 |
| gCTLA4_16 | GGCAGGCTGACAGCCAGGTGA | 319 | 1.2 |
| gCTLA4_17 | AGTCACCTGGCTGTCAGCCTG | 320 | 0.4 |
| gCTLA4_18 | CTAGATGATTCCATCTGCACG | 154 | 2.0 |
| gCTLA4_19 | CACTGGAGGTGCCCGTGCAGA | 798 | 42.5 |
| gCTLA4_20 | ATTTCCACTGGAGGTGCCCGT | 321 | 0.1 |
| gCTLA4_21 | GATAGTGAGGTTCACTTGATT | 322 | 0.6 |
| gCTLA4_22 | CAGATGTAGAGTCCCGTGTCC | 323 | 0.6 |
| gCTLA4_23 | CTCACCAATTACATAAATCTG | 324 | 0.8 |
| gCTLA4_24 | GCTCACCAATTACATAAATCT | 325 | 1.0 |
| gCTLA4_25 | GTTTTCTGTTGCAGATCCAGA | 326 | 0.1 |
| gCTLA4_26 | TTTTCTGTTGCAGATCCAGAA | 327 | 0.1 |
| gCTLA4_27 | CTGTTGCAGATCCAGAACCGT | 149 | 5.0 |
| gCTLA4_28 | CTCCTCTGGATCCTTGCAGCA | 152 | 3.0 |
| gCTLA4_29 | CAGCAGTTAGTTCGGGGTTGT | 328 | 0.7 |
| gCTLA4_30 | TTTATAGCTTTCTCCTCACAG | 329 | 0.6 |
| gCTLA4_31 | CTCCTCACAGCTGTTTCTTTG | 330 | 1.0 |
| gCTLA4_32 | TCCTCACAGCTGTTTCTTTGA | 331 | 0.7 |
| gCTLA4_33 | GCTCAAAGAAACAGCTGTGAG | 332 | 0.8 |
| gCTLA4_34 | TTTTTGTGTTTGACAGCTAAA | 333 | 0.5 |
| gCTLA4_35 | TGTGTTTGACAGCTAAAGAAA | 334 | 0.1 |
| gCTLA4_36 | ACAGCTAAAGAAAAGAAGCCC | 150 | 3.9 |
| gCTLA4_37 | CACATAGACCCCTGTTGTAAG | 153 | 2.9 |
| gCTLA4_38 | CACATTCTGGCTCTGTTGGGG | 335 | 0.2 |
| gCTLA4_39 | TCACATTCTGGCTCTGTTGGG | 336 | 0.3 |
| gCTLA4_40 | AGCCTTATTTTATTCCCATCA | 337 | 0.3 |
| gCTLA4_41 | TCAATTGATGGGAATAAAATA | 151 | 3.0 |

TABLE 9

Tested crRNAs Targeting Human DCK Gene

| crRNA | Spacer Sequence | SEQ ID NO | % Indel |
|---|---|---|---|
| gDCK_1 | TCTTGGGCGGGGTGGCCATTC | 338 | 0.1 |
| gDCK_2 | TCAGCCAGCTCTGAGGGGACC | 71 | 50.4 |

TABLE 9-continued

Tested crRNAs Targeting Human DCK Gene

| crRNA | Spacer Sequence | SEQ ID NO | % Indel |
|---|---|---|---|
| gDCK_3 | CTTGATGCGGGTCCCCTCAGA | 339 | 0.3 |
| gDCK_4 | GATGGAGATTTTCTTGATGCG | 340 | 0.3 |
| gDCK_5 | CCGATGTTCCCTTCGATGGAG | 341 | 0.5 |
| gDCK_6 | CGGAGGCTCCTTACCGATGTT | 796 | 85.1 |
| gDCK_7 | ATCTTTCCTCACAACAGCTGC | 159 | 1.5 |
| gDCK_8 | CTCACAACAGCTGCAGGGAAG | 72 | 31.7 |
| gDCK_9 | AGGATATTCACAAATGTTGAC | 156 | 8.1 |
| gDCK_10 | TGAATATCCTTAAACAATTGT | 342 | 1.0 |
| gDCK_11 | CCAATCTTCACACAATTGTTT | 343 | 0.1 |
| gDCK_12 | AACAATTGTGTGAAGATTGGG | 344 | 0.8 |
| gDCK_13 | AACATTGCACCATCTGGCAAC | 345 | 1.2 |
| gDCK_14 | GAACATTGCACCATCTGGCAA | 346 | 0.6 |
| gDCK_15 | CATACCTCAAATTCATCTTGA | 347 | 0.3 |
| gDCK_16 | ATTTTCATACCTCAAATTCAT | 348 | 0.1 |
| gDCK_17 | AATTTTATTTTCATACCTCAA | 349 | 0.0 |
| gDCK_18 | TGCACATTCAAAATAGGAACT | 350 | 0.4 |
| gDCK_19 | TCTGAGACATTGTAAGTTCCT | 351 | 0.7 |
| gDCK_20 | CAATGTCTCAGAAAAATGGTG | 352 | 0.6 |
| gDCK_21 | TCATACATCATCTGAAGAACA | 158 | 3.6 |
| gDCK_22 | GAAGGTAAAAGACCATCGTTC | 157 | 5.6 |
| gDCK_23 | ACCTTCCAAACATATGCCTGT | 353 | 1.2 |
| gDCK_24 | CAAACATATGCCTGTCTCAGT | 354 | 1.1 |
| gDCK_25 | CCATTCAGAGAGGCAAGCTGA | 355 | 0.9 |
| gDCK_26 | AGCTTGCCATTCAGAGAGGCA | 73 | 13.3 |
| gDCK_27 | CCTCTCTGAATGGCAAGCTCA | 356 | 1.1 |
| gDCK_28 | TCTGCATCTTTGAGCTTGCCA | 357 | 0.1 |
| gDCK_29 | TTGAACGATCTGTGTATAGTG | 358 | 0.2 |
| gDCK_30 | TACATACCTGTCACTATACAC | 74 | 12.8 |
| gDCK_31 | AGGTATATTTTGCATCTAAT | 359 | 0.05 |

TABLE 10

Tested crRNAs Targeting Human FAS Gene

| crRNA | Spacer Sequence | SEQ ID NO | % Indel |
|---|---|---|---|
| gFAS_1 | GGAGGATTGCTCAACAACCAT | 78 | 22.6 |
| gFAS_2 | TATTTTACAGGTTCTTACGTC | 360 | 0.1 |
| gFAS_3 | ATTTTACAGGTTCTTACGTCT | 361 | 0.7 |
| gFAS_4 | ACAGGTTCTTACGTCTGTTGC | 172 | 1.5 |
| gFAS_5 | GGACGATAATCTAGCAACAGA | 165 | 1.9 |
| gFAS_6 | TGGACGATAATCTAGCAACAG | 362 | 0.0 |
| gFAS_7 | GGCATTAACACTTTTGGACGA | 363 | 0.1 |
| gFAS_8 | GAGTTGATGTCAGTCACTTGG | 364 | 0.1 |
| gFAS_9 | CAAGTTCTGAGTCTCAACTGT | 365 | 0.1 |
| gFAS_10 | GAAGGCCTGCATCATGATGGC | 163 | 2.4 |
| gFAS_11 | TGGCAGAATTGGCCATCATGA | 366 | 0.8 |
| gFAS_12 | GTGTAACATACCTGGAGGACA | 77 | 29.9 |
| gFAS_13 | TTTCCTTGGGCAGGTGAAAGG | 367 | 1.1 |
| gFAS_14 | TTCCTTGGGCAGGTGAAAGGA | 166 | 1.7 |
| gFAS_15 | GGCAGGTGAAAGGAAAGCTAG | 173 | 1.5 |
| gFAS_16 | TTGGCAGGGCACGCAGTCTGG | 368 | 0.7 |
| gFAS_17 | CCTTCTTGGCAGGGCACGCAG | 369 | 0.8 |
| gFAS_18 | TCTGTGTACTCCTTCCCTTCT | 370 | 1.0 |
| gFAS_19 | GTCTGTGTACTCCTTCCCTTC | 371 | 0.6 |
| gFAS_20 | GAAGAAAATGGGCTTTGTCT | 372 | 0.7 |
| gFAS_21 | TCTTCCAAATGCAGAAGATGT | 373 | 0.7 |
| gFAS_22 | ATCACACAATCTACATCTTCT | 374 | 0.5 |
| gFAS_23 | AAGACTCTTACCATGTCCTTC | 375 | 0.6 |
| gFAS_24 | CAAACTGATTTTCTAGGCTTA | 376 | 0.1 |
| gFAS_25 | CTAGGCTTAGAAGTGGAAATA | 162 | 3.5 |
| gFAS_26 | GAAGTGGAAATAAACTGCACC | 377 | 0.3 |
| gFAS_27 | GTATTCTGGGTCCGGGTGCAG | 378 | 1.3 |
| gFAS_28 | CATCTGCACTTGGTATTCTGG | 379 | 1.2 |
| gFAS_29 | GTTTACATCTGCACTTGGTAT | 167 | 1.6 |
| gFAS_30 | TTTTGTAACTCTACTGTATGT | 380 | 0.8 |
| gFAS_31 | TTTGTAACTCTACTGTATGTG | 381 | 1.4 |
| gFAS_32 | GTGCAAGGGTCACAGTGTTCA | 164 | 2.4 |
| gFAS_33 | CTTGGTGCAAGGGTCACAGTG | 168 | 1.6 |
| gFAS_34 | TTTTTCTAGATGTGAACATGG | 75 | 59.1 |
| gFAS_35 | ATGATTCCATGTTCACATCTA | 76 | 58.5 |
| gFAS_36 | GTGTTGCTGGTGAGTGTGCAT | 57 | 61.9 |
| gFAS_37 | CACTTGGTGTTGCTGGTGAGT | 382 | 1.3 |
| gFAS_38 | CTCTTTGCACTTGGTGTTGCT | 170 | 1.5 |
| gFAS_39 | GGGTGGCTTTGTCTTCTTCTT | 383 | 0.1 |
| gFAS_40 | GTCTTCTTCTTTTGCCAATTC | 384 | 0.6 |
| gFAS_41 | TCTTCTTCTTTTGCCAATTCC | 385 | 0.1 |
| gFAS_42 | GCCAATTCCACTAATTGTTTG | 386 | 0.4 |

TABLE 10-continued

Tested crRNAs Targeting Human FAS Gene

| crRNA | Spacer Sequence | SEQ ID NO | % Indel |
|---|---|---|---|
| gFAS_43 | CCCCAAACAATTAGTGGAATT | 387 | 0.4 |
| gFAS_44 | AACAAAGCAAGAACTTACCCC | 388 | 0.3 |
| gFAS_45 | TTTGTTCTTTCAGTGAAGAGA | 161 | 6.0 |
| gFAS_46 | TTCTTTCAGTGAAGAGAAAGG | 389 | 0.9 |
| gFAS_47 | AGTGAAGAGAAAGGAAGTACA | 160 | 9.8 |
| gFAS_48 | CTGTACTTCCTTTCTCTTCAC | 390 | 0.8 |
| gFAS_49 | TGCATGTTTTCTGTACTTCCT | 391 | 0.6 |
| gFAS_50 | CTGCATGTTTTCTGTACTTCC | 392 | 0.4 |
| gFAS_51 | TGTGCTTTCTGCATGTTTTCT | 393 | 0.3 |
| gFAS_52 | CTGTGCTTTCTGCATGTTTTC | 394 | 0.3 |
| gFAS_53 | CCTTTCTGTGCTTTCTGCATG | 395 | 0.3 |
| gFAS_54 | GTTTTCCTTTCTGTGCTTTCT | 396 | 0.4 |
| gFAS_55 | AAGTTGGAGATTCATGAGAAC | 397 | 0.4 |
| gFAS_56 | AATACCTACAGGATTTAAAGT | 398 | 0.3 |
| gFAS_57 | TTGCTTTCTAGGAAACAGTGG | 399 | 1.1 |
| gFAS_58 | CTAGGAAACAGTGGCAATAAA | 400 | 1.3 |
| gFAS_59 | TAGGAAACAGTGGCAATAAAT | 79 | 11.0 |
| gFAS_60 | CCAGATAAATTTATTGCCACT | 401 | 0.7 |
| gFAS_61 | CTATTTTTCAGATGTTGACTT | 402 | 0.1 |
| gFAS_62 | TCAGATGTTGACTTGAGTAAA | 403 | 0.6 |
| gFAS_63 | AGTAAATATATCACCACTATT | 404 | 0.8 |
| gFAS_64 | AACTTGACTTAGTGTCATGAC | 405 | 0.4 |
| gFAS_65 | GAACAAAGCCTTTAACTTGAC | 406 | 0.5 |
| gFAS_66 | GTTCGAAAGAATGGTGTCAAT | 407 | 0.9 |
| gFAS_67 | ATTGACACCATTCTTTCGAAC | 408 | 0.5 |
| gFAS_68 | TTCGAAAGAATGGTGTCAATG | 409 | 0.7 |
| gFAS_69 | GGCTTCATTGACACCATTCTT | 410 | 0.4 |
| gFAS_70 | TGTTCTGCTGTGTCTTGGACA | 171 | 1.5 |
| gFAS_71 | CTGTTCTGCTGTGTCTTGGAC | 169 | 1.5 |
| gFAS_72 | GTAATTGGCATCAACTTCATG | 411 | 0.3 |
| gFAS_73 | CATGAAGTTGATGCCAATTAC | 412 | 0.8 |
| gFAS_74 | TTTCCATGAAGTTGATGCCAA | 413 | 0.4 |
| gFAS_75 | TTTCTTTCCATGAAGTTGATG | 414 | 0.5 |
| gFAS_76 | ATGGAAAGAAAGAAGCGTATG | 415 | 1.3 |
| gFAS_77 | ATCAATGTGTCATACGCTTCT | 416 | 0.8 |
| gFAS_78 | TTGAGATCTTTAATCAATGTG | 417 | 1.0 |
| gFAS_79 | TTTGAGATCTTTAATCAATGT | 418 | 0.9 |
| gFAS_80 | CTCTGCAAGAGTACAAAGATT | 419 | 0.2 |
| gFAS_81 | TACTCTTGCAGAGAAAATTCA | 420 | 0.2 |
| gFAS_82 | AGGATGATAGTCTGAATTTTC | 421 | 0.4 |
| gFAS_83 | CTGAGTCACTAGTAATGTCCT | 422 | 0.7 |
| gFAS_84 | AATTTTCTGAGTCACTAGTAA | 423 | 0.6 |
| gFAS_85 | TGAAGTTTGAATTTTCTGAGT | 424 | 0.4 |
| gFAS_86 | ATTTCTGAAGTTTGAATTTTC | 425 | 0.3 |
| gFAS_87 | GATTTCATTTCTGAAGTTTGA | 426 | 0.5 |
| gFAS_88 | GGATTTCATTTCTGAAGTTTG | 427 | 0.5 |
| gFAS_89 | AGAAATGAAATCCAAAGCTTG | 428 | 0.5 |
| gFAS_90 | TCACTCTAGACCAAGCTTTGG | 429 | 0.5 |
| gFAS_91 | TTGTTTTTCACTCTAGACCAA | 430 | 0.7 |
| gFAS_92 | GTCTAGAGTGAAAAACAACAA | 431 | 0.5 |

TABLE 11

Tested crRNAs Targeting Human HAVCR2 Gene

| crRNA | Spacer Sequence | SEQ ID NO | % Indel |
|---|---|---|---|
| gTIM3_1 | TCTTCTGCAAGCTCCATGTTT | 432 | 0.1 |
| gTIM3_2 | TCTTCTGCAAGCTCCATGTTT | 433 | 0.07 |
| gTIM3_3 | CTTCTGCAAGCTCCATGTTTT | 434 | 0.1 |
| gTIM3_4 | CACATCTTCCCTTTGACTGTG | 435 | 0.8 |
| gTIM3_5 | GACTGTGTCCTGCTGCTGCTG | 436 | 0.8 |
| gTIM3_6 | TAAGTAGTAGCAGCAGCAGCA | 799 | 53.7 |
| gTIM3_7 | CTTGTAAGTAGTAGCAGCAGC | 58 | 64.4 |
| gTIM3_8 | TCTCTCTATGCAGGGTCCTCA | 437 | 0.1 |
| gTIM3_9 | TACACCCCAGCCGCCCCAGGG | 438 | 1.0 |
| gTIM3_10 | CCCCAGCAGACGGGCACGAGG | 175 | 7.3 |
| gTIM3_11 | GCCCCAGCAGACGGGCACGAG | 439 | 0.6 |
| gTIM3_12 | AATGTGGCAACGTGGTGCTCA | 84 | 21.9 |
| gTIM3_13 | ATCAGTCCTGAGCACCACGTT | 187 | 1.5 |
| gTIM3_14 | CATCAGTCCTGAGCACCACGT | 440 | 0.1 |
| gTIM3_15 | GCCAGTATCTGGATGTCCAAT | 181 | 2.9 |
| gTIM3_16 | CGGAAATCCCCATTTAGCCAG | 441 | 0.4 |
| gTIM3_17 | GCGGAAATCCCCATTTAGCCA | 442 | 0.1 |
| gTIM3_18 | CGCAAAGGAGATGTGTCCCTG | 86 | 14.4 |
| gTIM3_19 | GATCCGGCAGCAGTAGATCCC | 178 | 5.1 |
| gTIM3_20 | TCATCATTCATTATGCCTGGG | 443 | 0.1 |

TABLE 11-continued

Tested crRNAs Targeting Human HAVCR2 Gene

| crRNA | Spacer Sequence | SEQ ID NO | % Indel |
|---|---|---|---|
| gTIM3_21 | AGGTTAAATTTTTCATCATTC | 444 | 0.1 |
| gTIM3_22 | ATGACCAACTTCAGGTTAAAT | 445 | 0.1 |
| gTIM3_23 | ACCTGAAGTTGGTCATCAAAC | 184 | 2.2 |
| gTIM3_24 | TGTTGTTTCTGACATTAGCCA | 446 | 0.7 |
| gTIM3_25 | TGACATTAGCCAAGGTCACCC | 85 | 15.7 |
| gTIM3_26 | GAAAGGCTGCAGTGAAGTCTC | 447 | 0.1 |
| gTIM3_27 | ACTGCAGCCTTTCCAAGGATG | 182 | 2.6 |
| gTIM3_28 | CCAAGGATGCTTACCACCAGG | 185 | 1.9 |
| gTIM3_29 | CAAGGATGCTTACCACCAGGG | 80 | 59.8 |
| gTIM3_30 | CCACCAGGGGACATGGCCCAG | 83 | 22.1 |
| gTIM3_31 | TATAGCAGAGACACAGACACT | 448 | 0.3 |
| gTIM3_32 | TATCAGGGAGGCTCCCCAGTG | 800 | 22.4 |
| gTIM3_33 | CTGTTAGATTTATATCAGGGA | 449 | 1.4 |
| gTIM3_34 | TGTTTCCATAGCAAATATCCA | 177 | 5.6 |
| gTIM3_35 | CATAGCAAATATCCACATTGG | 450 | 1.0 |
| gTIM3_36 | CGGGACTCTGGAGCAACCATC | 180 | 3.3 |
| gTIM3_37 | AAAATTAAAGCGCCGAAGATA | 451 | 0.2 |
| gTIM3_38 | CATTTGAAAATTAAAGCGCCG | 452 | 0.1 |
| gTIM3_39 | TGTTTCCCCCTTACTAGGGTA | 453 | 0.7 |
| gTIM3_40 | GTTTCCCCCTTACTAGGGTAT | 186 | 1.7 |
| gTIM3_41 | CCCCTTACTAGGGTATTCTCA | 183 | 2.2 |
| gTIM3_42 | CTAGGGTATTCTCATAGCAAA | 174 | 8.5 |
| gTIM3_43 | AATTCTGTATCTTCTCTTTGC | 454 | 0.7 |
| gTIM3_44 | ATTTCCACAGCCTCATCTCTT | 455 | 0.4 |
| gTIM3_45 | TTTCCACAGCCTCATCTCTTT | 456 | 1.0 |
| gTIM3_46 | CACAGCCTCATCTCTTTGGCC | 457 | 0.5 |
| gTIM3_47 | GCCAACCTCCCTCCCTCAGGA | 176 | 6.0 |
| gTIM3_48 | CCAATCCTGAGGGAGGGAGGT | 179 | 4.5 |
| gTIM3_49 | CTTCTGAGCGAATTCCCTCTG | 458 | 0.7 |
| gTIM3_50 | ATATACGTTCTCTTCAATGGT | 459 | 0.5 |
| gTIM3_51 | GGGTTGTCGCTTTGCAATGCC | 460 | 0.5 |

TABLE 12

Tested crRNAs Targeting Human LAG3 Gene

| crRNA | Spacer Sequence | SEQ ID NO | % Indel |
|---|---|---|---|
| gLAG3_1 | CTGTTTCTGCAGCCGCTTTGG | 461 | 0.2 |
| gLAG3_2 | TGCAGCCGCTTTGGGTGGCTC | 462 | 0.2 |
| gLAG3_3 | ACCTGGAGCCACCCAAAGCGG | 195 | 3.1 |
| gLAG3_4 | GCTCACCTAGTGAAGCCTCTC | 463 | 1.3 |
| gLAG3_5 | TGCGAAGAGCAGGGGTCACTT | 464 | 0.8 |
| gLAG3_6 | GGGTGCATACCTGTCTGGCTG | 59 | 52.4 |
| gLAG3_7 | CCGCCCAGTGGCCCGCCCGCT | 465 | N.D. |
| gLAG3_8 | TCGCTATGGCTGCGCCCAGCC | 466 | 0.1 |
| gLAG3_9 | TCCTTGCACAGTGACTGCCAG | 467 | N.D. |
| gLAG3_10 | CACAGTGACTGCCAGCCCCCC | 468 | N.D. |
| gLAG3_11 | GAACTGCTCCTTCAGCCGCCC | 469 | 0.1 |
| gLAG3_12 | AGCCGCCCTGACCGCCCAGCC | 470 | 0.1 |
| gLAG3_13 | CGCTAAGTGGTGATGGGGGA | 197 | 2.3 |
| gLAG3_14 | CCGCTAAGTGGTGATGGGGGG | 471 | 0.3 |
| gLAG3_15 | GCGGAAAGCTTCCTCTTCCTG | 472 | 1.0 |
| gLAG3_16 | GGGCAGGAAGAGGAAGCTTTC | 191 | 6.4 |
| gLAG3_17 | CTCTTCCTGCCCCAAGTCAGC | 473 | 1.3 |
| gLAG3_18 | AACGTCTCCATCATGTATAAC | 474 | 1.1 |
| gLAG3_19 | CTTTTCTCTTCAGGTCTGGAG | 475 | 0.2 |
| gLAG3_20 | CTCTTCAGGTCTGGAGCCCCC | 476 | 0.2 |
| gLAG3_21 | ACAGTGTACGCTGGAGCAGGT | 477 | 0.1 |
| gLAG3_22 | GCAGTGAGGAAAGACCGGGTC | 198 | 2.1 |
| gLAG3_23 | CTCACTGCCAAGTGGACTCCT | 478 | 0.4 |
| gLAG3_24 | ACCCTTCGACTAGAGGATGTG | 479 | 0.8 |
| gLAG3_25 | CCCTTCGACTAGAGGATGTGA | 196 | 2.7 |
| gLAG3_26 | GACTAGAGGATGTGAGCCAGG | 480 | 1.0 |
| gLAG3_27 | CCACCTGAGGCTGACCTGTGA | 193 | 3.4 |
| gLAG3_28 | CCCACCTGAGGCTGACCTGTG | 481 | 0.8 |
| gLAG3_29 | TACTCTTTTCAGTGACTCCCA | 482 | 0.3 |
| gLAG3_30 | CAGTGACTCCCAAATCCTTTG | 483 | 0.1 |
| gLAG3_31 | CCCAGGGATCCAGGTGACCCA | 194 | 3.1 |
| gLAG3_32 | GGGTCACCTGGATCCCTGGGG | 484 | 0.2 |
| gLAG3_33 | GGTCACCTGGATCCCTGGGGA | 88 | 17.1 |
| gLAG3_34 | GTGAGGTGACTCCAGTATCTG | 485 | 0.7 |
| gLAG3_35 | TGAGGTGACTCCAGTATCTGG | 188 | 9.3 |
| gLAG3_36 | GTGTGGAGCTCTCTGGACACC | 486 | 0.9 |
| gLAG3_37 | TGTGGAGCTCTCTGGACACCC | 190 | 6.9 |
| gLAG3_38 | TCAGGACCTTGGCTGGAGGCA | 87 | 17.7 |

TABLE 12-continued

Tested crRNAs Targeting Human LAG3 Gene

| crRNA | Spacer Sequence | SEQ ID NO | % Indel |
|---|---|---|---|
| gLAG3_39 | GCTGGAGGCACAGGAGGCCCA | 487 | 0.3 |
| gLAG3_40 | CCCAGCCTTGGCAATGCCAGC | 488 | 0.8 |
| gLAG3_41 | CCAGCCTTGGCAATGCCAGCT | 189 | 8.3 |
| gLAG3_42 | GCAATGCCAGCTGTACCAGGG | 489 | 0.6 |
| gLAG3_43 | TTGGAGCAGCAGTGTACTTCA | 490 | 0.8 |
| gLAG3_44 | ACAGAGCTGTCTAGCCCAGGT | 491 | 0.4 |
| gLAG3_45 | CTCCATAGGTGCCCAACGCTC | 492 | 1.3 |
| gLAG3_46 | TCCATAGGTGCCCAACGCTCT | 192 | 4.0 |
| gLAG3_47 | TCATCCTTGGTGTCCTTTCTC | 493 | 0.4 |
| gLAG3_48 | GTGTCCTTTCTCTGCTCCTTT | 494 | 0.1 |
| gLAG3_49 | CTCTGCTCCTTTTGGTGACTG | 495 | 0.2 |
| gLAG3_50 | TCTGCTCCTTTTGGTGACTGG | 496 | 0.1 |
| gLAG3_51 | TGGTGACTGGAGCCTTTGGCT | 497 | 0.6 |
| gLAG3_52 | GGTGACTGGAGCCTTTGCTT | 498 | 0.2 |
| gLAG3_53 | GGCTTTCACCTTTGGAGAAGA | 499 | 0.1 |
| gLAG3_54 | GCTTTCACCTTTGGAGAAGAC | 500 | 0.2 |
| gLAG3_55 | CTCTAAGGCAGAAAATCGTCT | 501 | 0.1 |
| gLAG3_56 | CTGCCTTAGAGCAAGGGATTC | 502 | 0.1 |
| gLAG3_57 | GAGCAAGGGATTCACCCTCCG | 503 | 0.2 |

TABLE 13

Tested crRNAs Targeting Human PDCD1 Gene

| crRNA | Spacer Sequence | SEQ ID NO | % Indel |
|---|---|---|---|
| gPD_1 | AACCTGACCTGGGACAGTTTC | 504 | 0.2 |
| gPD_2 | CCTTCCGCTCACCTCCGCCTG | 89 | 46.9 |
| gPD_3 | CGCTCACCTCCGCCTGAGCAG | 505 | 1.0 |
| gPD_4 | TCCACTGCTCAGGCGGAGGTG | 506 | 0.6 |
| gPD_5 | TCCCCAGCCCTGCTCGTGGTG | 507 | 1.2 |
| gPD_6 | GGTCACCACGAGCAGGGCTGG | 508 | 0.7 |
| gPD_7 | ACCTGCAGCTTCTCCAACACA | 509 | 0.2 |
| gPD_8 | GCACGAAGCTCTCCGATGTGT | 90 | 41.7 |
| gPD_9 | TCCAACACATCGGAGAGCTTC | 510 | 0.2 |
| gPD_10 | GTGCTAAACTGGTACCGCATG | 511 | 0.2 |
| gPD_11 | TCCGTCTGGTTGCTGGGGCTC | 512 | 0.1 |
| gPD_12 | CCCGAGGACCGCAGCCAGCCC | 513 | 0.4 |
| gPD_13 | CGTGTCACACAACTGCCCAAC | 514 | 0.5 |
| gPD_14 | CACATGAGCGTGGTCAGGGCC | 515 | 0.1 |
| gPD_15 | GATCTGCGCCTTGGGGGCCAG | 516 | 0.1 |
| gPD_16 | ATCTGCGCCTTGGGGGCCAGG | 517 | 1.2 |
| gPD_17 | GGGGCCAGGGAGATGGCCCCA | 518 | 0.6 |
| gPD_18 | GTGCCCTTCCAGAGAGAAGGG | 201 | 1.7 |
| gPD_19 | TGCCCTTCCAGAGAGAAGGGC | 519 | 0.9 |
| gPD_20 | CAGAGAGAAGGGCAGAAGTGC | 199 | 2.5 |
| gPD_21 | TGCCCTTCTCTCTGGAAGGGC | 520 | 1.4 |
| gPD_22 | GAACTGGCCGGCTGGCCTGGG | 200 | 1.7 |
| gPD_23 | TCTGCAGGGACAATAGGAGCC | 60 | 57.6 |
| gPD_24 | CTCCTCAAAGAAGGAGGACCC | 521 | 0.1 |
| gPD_25 | TCCTCAAAGAAGGAGGACCCC | 522 | 0.5 |
| gPD_26 | TCTCGCCACTGGAAATCCAGC | 523 | 0.2 |
| gPD_27 | CAGTGGCGAGAGAAGACCCCG | 92 | 23.7 |
| gPD_28 | CCTAGCGGAATGGGCACCTCA | 524 | 0.1 |
| gPD_29 | CTAGCGGAATGGGCACCTCAT | 91 | 30.3 |
| gPD_30 | GCCCCTCTGACCGGCTTCCTT | 525 | 0.3 |

TABLE 14

Tested crRNAs Targeting Human PTPN6 Gene

| crRNA | Spacer Sequence | SEQ ID NO | % Indel |
|---|---|---|---|
| gPTPN6_1 | ACCGAGACCTCAGTGGGCTGG | 96 | 58.2 |
| gPTPN6_2 | AGCAGGGTCTCTGCATCCAGC | 526 | 0.3 |
| gPTPN6_4 | CTGGCTCGGCCCAGTCGCAAG | 208 | 4.3 |
| gPTPN6_5 | TCCCCTCCATACAGGTCATAG | 803 | 14.8 |
| gPTPN6_6 | TATGACCTGTATGGAGGGGAG | 61 | 83.4 |
| gPTPN6_7 | CGACTCTGACAGAGCTGGTGG | 801 | 78.1 |
| gPTPN6_8 | AGGTGGATGATGGTGCCGTCG | 209 | 3.5 |
| gPTPN6_9 | CCTGACGCTGCCTTCTCTAGG | 527 | 0.8 |
| 9PTPN6_10 | TCTAGGTGGTACCATGGCCAC | 212 | 2.4 |
| gPTPN6_11 | GCCTGCAGCAGCGTCTCTGCC | 528 | 0.2 |
| gPTPN6_12 | TTGTGCGTGAGAGCCTCAGCC | 100 | 29.4 |
| gPTPN6_13 | GTGCTTTCTGTGCTCAGTGAC | 529 | 0.8 |
| gPTPN6_14 | GGCTGGTCACTGAGCACAGAA | 104 | 10.4 |
| gPTPN6_15 | CTGTGCTCAGTGACCAGCCCA | 530 | 0.5 |
| 9PTPN6_16 | TGTGCTCAGTGACCAGCCCAA | 98 | 37.5 |
| 9PTPN6_17 | ATGTGGGTGACCCTGAGCGGG | 531 | 0.9 |

TABLE 14-continued

Tested crRNAs Targeting Human PTPN6 Gene

| crRNA | Spacer Sequence | SEQ ID NO | % Indel |
|---|---|---|---|
| gPTPN6_18 | CCTCGCACATGACCTTGATGT | 532 | 1.4 |
| gPTPN6_19 | GCTCCCCCAGGGTGGACGCT | 103 | 13.5 |
| gPTPN6_20 | GAGACCTTCGACAGCCTCACG | 202 | 9.7 |
| gPTPN6_21 | GACAGCCTCACGGACCTGGTG | 533 | 0.5 |
| gPTPN6_22 | AAGAAGACGGGGATTGAGGAG | 101 | 22.3 |
| gPTPN6_23 | TTGTTCAGTTCCAACACTCGG | 534 | 0.1 |
| gPTPN6_24 | GCTGTATCCTCGGACTCCTGC | 535 | 0.4 |
| gPTPN6_25 | CCCACCCACATCTCAGAGTTT | 99 | 34.8 |
| gPTPN6_26 | CAGAAGCAGGAGGTGAAGAAC | 802 | 77.5 |
| gPTPN6_27 | CAGACGCTGGTGCAAGTTCTT | 536 | 0.3 |
| gPTPN6_28 | CACCAGCGTCTGGAAGGGCAG | 205 | 5.4 |
| gPTPN6_29 | TTCTCTGGCCGCTGCCCTTCC | 537 | 0.1 |
| gPTPN6_30 | ATGTAGTTGGCATTGATGTAG | 538 | 0.2 |
| gPTPN6_31 | CGTCCAGAACCAGCTGCTAGG | 539 | 0.3 |
| gPTPN6_32 | TGGCAGATGGCGTGGCAGGAG | 207 | 4.4 |
| gPTPN6_33 | TCCACCTCTCGGGTGGTCATG | 540 | 0.7 |
| gPTPN6_34 | CTCCACCTCTCGGGTGGTCAT | 541 | 1.2 |
| gPTPN6_35 | CCAGAACAAATGCGTCCCATA | 542 | 0.2 |
| gPTPN6_36 | CAGAACAAATGCGTCCCATAC | 543 | 0.5 |
| gPTPN6_37 | TGGGCCCTACTCTGTGACCAA | 97 | 51.3 |
| gPTPN6_38 | TATTCGGTTGTGTCATGCTCC | 544 | 0.1 |
| gPTPN6_39 | CAGGTCTCCCCGCTGGACAAT | 213 | 1.6 |
| gPTPN6_40 | GGGAGACCTGATTCGGGAGAT | 210 | 3.4 |
| gPTPN6_41 | CTGGACCAGATCAACCAGCGG | 203 | 8.4 |
| gPTPN6_42 | CTGCCGCTGGTTGATCTGGTC | 206 | 5.3 |
| gPTPN6_43 | CCTGCCGCTGGTTGATCTGGT | 545 | 0.3 |
| gPTPN6_44 | CCCAGCGCCGGCATCGGCCGC | 546 | N.D. |
| gPTPN6_45 | GTGGAGATGTTCTCCATGAGC | 547 | N.D. |
| gPTPN6_46 | ACTGCCCCCCACCCAGGCCTG | 93 | 80.3 |
| gPTPN6_47 | TACTCGCCTCCGTCTGCACC | 548 | 0.1 |
| gPTPN6_48 | AATGAACTGGGCGATGGCCAC | 211 | 3.3 |
| gPTPN6_49 | TTCTTAGTGGTTTCAATGAAC | 549 | 0.1 |
| gPTPN6_50 | GCATGGGCATTCTTCATGGCT | 550 | N.D. |
| gPTPN6_51 | GACGAGGTGCGGGAGGCCTTG | 551 | N.D. |
| gPTPN6_52 | GAGTCTAGTGCAGGGACCGTG | 552 | 0.1 |
| gPTPN6_53 | CCCCCCTGCACCCGGCTGCAG | 204 | 7.0 |
| gPTPN6_54 | TGTCTGCAGCCGGGTGCAGGG | 553 | 0.9 |
| gPTPN6_55 | TCCTCCCTCTTGTTCTTAGTG | 554 | 0.0 |
| gPTPN6_56 | CTCCTCCCTCTTGTTCTTAGT | 555 | 0.1 |
| gPTPN6_57 | TTCACTTTCTCCTCCCTCTTG | 556 | 0.2 |

TABLE 15

Tested crRNAs Targeting Human TIGIT Gene

| crRNA | Spacer Sequence | SEQ ID NO | % Indel |
|---|---|---|---|
| gTIGIT_1 | CCTGAGGCGAGGGAGCCTGC | 557 | 0.2 |
| gTIGIT_2 | AGGCCTTACCTGAGGCGAGGG | 62 | 81.7 |
| gTIGIT_3 | GTCCTCTTCCCTAGGAATGAT | 558 | 1.3 |
| gTIGIT_4 | TATTGTGCCTGTCATCATTCC | 559 | 1.0 |
| gTIGIT_5 | TCTGCAGAAATGTTCCCCGTT | 560 | 1.1 |
| gTIGIT_6 | CTCTGCAGAAATGTTCCCCGT | 561 | 0.1 |
| gTIGIT_7 | TGCAGAGAAAGGTGGCTCTAT | 215 | 6.0 |
| gTIGIT_8 | TGCCGTGGTGGAGGAGAGGTG | 562 | 0.3 |
| gTIGIT_9 | TGGCCATTTGTAATGCTGACT | 563 | 0.8 |
| gTIGIT_10 | TAATGCTGACTTGGGGTGGCA | 216 | 1.6 |
| gTIGIT_11 | GGGTGGCACATCTCCCCATCC | 214 | 9.7 |
| gTIGIT_12 | AAGGATGGGGAGATGTGCCAC | 564 | 0.4 |
| gTIGIT_13 | AAGGATCGAGTGGCCCCAGGT | 565 | 0.2 |
| gTIGIT_14 | TGCATCTATCACACCTACCCT | 566 | 1.4 |
| gTIGIT_15 | TAGGACCTCCAGGAAGATTCT | 567 | 0.4 |
| gTIGIT_16 | CTAGGACCTCCAGGAAGATTC | 568 | 0.5 |
| gTIGIT_17 | CTCCAGCAGGAATACCTGAGC | 569 | 0.8 |
| gTIGIT_18 | GTCCTCCCTCTAGTGGCTGAG | 105 | 72.4 |
| gTIGIT_19 | GAGCCATGGCCGCGACGCTGG | 570 | 0.9 |
| gTIGIT_20 | TAGTCAACGCGACCACCACGA | 571 | 0.1 |
| gTIGIT_21 | CTAGTCAACGCGACCACCACG | 572 | 0.1 |
| gTIGIT_22 | TAGTTTGTTTGTTTTTAGAAG | 573 | 0.6 |
| gTIGIT_23 | TTTGTTTTTAGAAGAAAGCCC | 574 | 1.0 |
| gTIGIT_24 | TTTTTAGAAGAAAGCCCTCAG | 575 | 0.4 |
| gTIGIT_25 | TAGAAGAAAGCCCTCAGAATC | 576 | 1.2 |
| gTIGIT_26 | CACAGAATGGATTCTGAGGGC | 577 | 0.3 |
| gTIGIT_27 | CTCCTGAGGTCACCTTCCACA | 217 | 1.6 |
| gTIGIT_28 | CTGGGGGTGAGGGAGCACTGG | 578 | 0.5 |

TABLE 15-continued

Tested crRNAs Targeting Human TIGIT Gene

| crRNA | Spacer Sequence | SEQ ID NO | % Indel |
|---|---|---|---|
| gTIGIT_29 | TGCCTGGACACAGCTTCCTGG | 579 | 0.3 |
| gTIGIT_30 | TGTAACTCAGGACATTGAAGT | 580 | 0.5 |
| gTIGIT_31 | AATGTCCTGAGTTACAGAAGC | 581 | 0.5 |

TABLE 16

Tested crRNAs Targeting Human TRAC Gene

| crRNA | Spacer Sequence | SEQ ID NO | % Indel |
|---|---|---|---|
| gTRAC001 | TGTTTTTAATGTGACTCTCAT | 237 | 1.8 |
| gTRAC002 | GTGTTTTTAATGTGACTCTCA | 582 | 0.4 |
| gTRAC003 | CGTAGGATTTTGTGTTTTTAA | 583 | 0.1 |
| gTRAC004 | CTTAGTGCTGAGACTCATTCT | 584 | 0.7 |
| gTRAC005 | CCTTAGTGCTGAGACTCATTC | 585 | 0.6 |
| gTRAC006 | TGAGGGTGAAGGATAGACGCT | 63 | 81.8 |
| gTRAC007 | ATAAACTGTAAAGTACCAAAC | 239 | 1.7 |
| gTRAC008 | TTTGGTACTTTACAGTTTATT | 586 | 0.2 |
| gTRAC009 | GTACTTTACAGTTTATTAAAT | 238 | 1.7 |
| gTRAC010 | CAGTTTATTAAATAGATGTTT | 587 | 0.5 |
| gTRAC011 | TTAAATAGATGTTTATATGGA | 588 | 0.0 |
| gTRAC012 | TATGGAGAAGCTCTCATTTCT | 110 | 46.7 |
| gTRAC013 | TTTCTCAGAAGAGCCTGGCTA | 225 | 5.8 |
| gTRAC014 | TCAGAAGAGCCTGGCTAGGAA | 127 | 16.6 |
| gTRAC015 | ACCTGCAAAATGAATATGGTG | 589 | 0.0 |
| gTRAC016 | GCAGGTGAAATTCCTGAGATG | 590 | 0.2 |
| gTRAC017 | CAGGTGAAATTCCTGAGATGT | 804 | 63.6 |
| gTRAC018 | CTCGATATAAGGCCTTGAGCA | 120 | 26.0 |
| gTRAC019 | AACTATAAATCAGAACACCTG | 228 | 4.5 |
| gTRAC020 | GAACTATAAATCAGAACACCT | 224 | 6.4 |
| gTRAC021 | TAGTTCAAAACCTCTATCAAT | 117 | 27.7 |
| gTRAC022 | TGGTATGTTGGCATTAAGTTG | 591 | 1.0 |
| gTRAC023 | CCAACTTAATGCCAACATACC | 592 | 1.4 |
| gTRAC024 | CTTTGCTGGGCCTTTTTCCCA | 593 | 1.0 |
| gTRAC025 | CTGGGCCTTTTTCCCATGCCT | 227 | 4.6 |
| gTRAC026 | TCCCATGCCTGCCTTTACTCT | 594 | 0.6 |
| gTRAC027 | CCCATGCCTGCCTTTACTCTG | 595 | 0.7 |
| gTRAC028 | CCATGCCTGCCTTTACTCTGC | 129 | 15.3 |
| gTRAC029 | CTCTGCCAGAGTTATATTGCT | 128 | 15.8 |
| gTRAC030 | ATAGGATCTTCTTCAAAACCC | 235 | 2.2 |

TABLE 16-continued

Tested crRNAs Targeting Human TRAC Gene

| crRNA | Spacer Sequence | SEQ ID NO | % Indel |
|---|---|---|---|
| gTRAC031 | TTTAATAGGATCTTCTTCAAA | 596 | 0.3 |
| gTRAC032 | ATTTAATAGGATCTTCTTCAA | 597 | 0.1 |
| gTRAC033 | GAAGAAGATCCTATTAAATAA | 236 | 2.0 |
| gTRAC034 | AAGAAGATCCTATTAAATAAA | 598 | 0.1 |
| gTRAC035 | AGGTTTCCTTGAGTGGCAGGC | 220 | 7.5 |
| gTRAC036 | CTTGAGTGGCAGGCCAGGCCT | 230 | 4.4 |
| gTRAC037 | AGTGAACGTTCACGGCCAGGC | 599 | 0.7 |
| gTRAC038 | TACGGGAAATAGCATCTTAGA | 114 | 40.7 |
| gTRAC039 | TAAGATGCTATTTCCCGTATA | 111 | 45.8 |
| gTRAC040 | CCGTATAAAGCATGAGACCGT | 124 | 21.5 |
| gTRAC041 | CCCCAACCCAGGCTGGAGTCC | 125 | 18.7 |
| gTRAC042 | CCTCTTTGCCCCAACCCAGGC | 219 | 7.6 |
| gTRAC043 | GAGTCTCTCAGCTGGTACACG | 121 | 25.9 |
| gTRAC044 | AGAATCAAAATCGGTGAATAG | 221 | 7.4 |
| gTRAC045 | TTTGAGAATCAAAATCGGTGA | 600 | 1.3 |
| gTRAC046 | TGACACATTTGTTTGAGAATC | 601 | 0.2 |
| gTRAC047 | GATTCTCAAACAAATGTGTCA | 602 | 0.1 |
| gTRAC048 | ATTCTCAAACAAATGTGTCAC | 229 | 4.5 |
| gTRAC049 | TCTGTGATATACACATCAGAA | 118 | 27.6 |
| gTRAC050 | GTCTGTGATATACACATCAGA | 130 | 11.4 |
| gTRAC055 | CACATGCAAAGTCAGATTTGT | 603 | 1.0 |
| gTRAC056 | CATGTGCAAACGCCTTCAACA | 231 | 3.9 |
| gTRAC057 | GTGCCTTCGCAGGCTGTTTCC | 604 | 0.9 |
| gTRAC058 | CTTGCTTCAGGAATGGCCAGG | 116 | 27.8 |
| gTRAC059 | GACATCATTGACCAGAGCTCT | 805 | 50.1 |
| gTRAC060 | AGACATCATTGACCAGAGCTC | 605 | 1.3 |
| gTRAC061 | GTGGCAATGGATAAGGCCGAG | 115 | 38.8 |
| gTRAC062 | GGTGGCAATGGATAAGGCCGA | 223 | 6.5 |
| gTRAC063 | TTAGTAAAAGAGGGTTTTGG | 606 | 1.4 |
| gTRAC064 | TACTAAGAAACAGTGAGCCTT | 232 | 3.5 |
| gTRAC065 | ACTAAGAAACAGTGAGCCTTG | 607 | 0.2 |
| gTRAC066 | CTAAGAAACAGTGAGCCTTGT | 218 | 9.5 |
| gTRAC067 | CCGTGTCATTCTCTGGACTGC | 112 | 45.4 |
| gTRAC068 | CCCGTGTCATTCTCTGGACTG | 226 | 5.3 |
| gTRAC069 | TCCCGTGTCATTCTCTGGACT | 608 | 1.0 |
| gTRAC070 | TTCCCGTGTCATTCTCTGGAC | 609 | 0.3 |
| gTRAC071 | CTCAGACTGTTTGCCCCTTAC | 233 | 3.4 |

TABLE 16-continued

Tested crRNAs Targeting Human TRAC Gene

| crRNA | Spacer Sequence | SEQ ID NO | % Indel |
|---|---|---|---|
| gTRAC072 | CCCCTTACTGCTCTTCTAGGC | 222 | 6.9 |
| gTRAC073 | GCAGACAGGGAGAAATAAGGA | 106 | 66.9 |
| gTRAC074 | GGCAGACAGGGAGAAATAAGG | 119 | 27.1 |
| gTRAC075 | TGGCAGACAGGGAGAAATAAG | 122 | 25.2 |
| gTRAC076 | TTGGCAGACAGGGAGAAATAA | 126 | 16.7 |
| gTRAC077 | TCCCTGTCTGCCAAAAATCT | 610 | 1.1 |
| gTRAC078 | CCAGCTCACTAAGTCAGTCTC | 109 | 47.4 |
| gTRAC079 | ATTCCTCCACTTCAACACCTG | 113 | 45.4 |
| gTRAC080 | AATTCCTCCACTTCAACACCT | 611 | 0.5 |
| gTRAC081 | TAATTCCTCCACTTCAACACC | 234 | 2.3 |
| gTRAC082 | CCAGCTGACAGATGGGCTCCC | 123 | 21.5 |
| gTRAC083 | CCCAGCTGACAGATGGGCTCC | 241 | 1.6 |
| gTRAC084 | GACTTTTCCCAGCTGACAGAT | 240 | 1.6 |
| gTRAC085 | TCAACCCTGAGTTAAAACACA | 612 | 0.5 |
| gTRAC086 | CTCAACCCTGAGTTAAAACAC | 613 | 0.2 |
| gTRAC087 | TCCTGAAGGTAGCTGTTTTCT | 614 | 0.2 |
| gTRAC088 | GTCCTGAAGGTAGCTGTTTTC | 615 | 0.1 |
| gTRAC089 | AACTCAGGGTTGAGAAAACAG | 616 | 0.7 |
| gTRAC090 | ACTCAGGGTTGAGAAAACAGC | 617 | 0.1 |

TABLE 17

Tested crRNAs Targeting Human TRBC1/TRBC2 Genes

| crRNA | Spacer Sequence | SEQ ID NO | % Indel |
|---|---|---|---|
| gTRBC1+2_1 | AGCCATCAGAAGCAGAGATCT | 705 | 66.40 (TRBC1); 74.7 (TRBC2) |
| gTRBC1+2_3 | CGCTGTCAAGTCCAGTTCTAC | 706 | 71.28 (TRBC1) |
| gTRBC2_7 | CCCTGTTTTCTTTCAGACTGT | 707 | 0.09 |
| gTRBC2_8 | CTTTCAGACTGTGGCTTCACC | 708 | 0.24 |
| gTRBC2_9 | TTTCAGACTGTGGCTTCACCT | 709 | 0.24 |
| gTRBC2_10 | CAGACTGTGGCTTCACCTCCG | 710 | 0.16 |
| gTRBC2_11 | AGACTGTGGCTTCACCTCCGG | 711 | 19.97 |
| gTRBC2_12 | CCGGAGGTGAAGCCACAGTCT | 712 | 33.14 |
| gTRBC2_13 | TCAACAGAGTCTTACCAGCAA | 713 | 1.20 |
| gTRBC2_14 | CCAGCAAGGGGTCCTGTCTGC | 714 | 6.69 |
| gTRBC2_15 | CTAGGGAAGGCCACCTTGTAT | 715 | 21.74 |
| gTRBC2_16 | TATGCCGTGCTGGTCAGTGCC | 716 | 0.20 |

TABLE 17-continued

Tested crRNAs Targeting Human TRBC1/TRBC2 Genes

| crRNA | Spacer Sequence | SEQ ID NO | % Indel |
|---|---|---|---|
| gTRBC2_17 | CCATGGCCATCAGCACGAGGG | 717 | 1.75 |
| gTRBC2_18 | CCTAGCAAGATCTCATAGAGG | 718 | 0.37 |
| gTRBC2_19 | CACAGGTCAAGAGAAAGGATT | 719 | 1.58 |
| gTRBC2_21 | GAGCTAGCCTCTGGAATCCTT | 720 | 11.89 |

TABLE 18

Tested crRNAs Targeting Human CARD11 Gene

| crRNA | Spacer Sequence | SEQ ID NO | % Indel |
|---|---|---|---|
| gCARD11_1 | TAGTACCGCTCCTGGAAGGTT | 721 | 1.37 |
| gCARD11_2 | ATCTTGTAGTACCGCTCCTGG | 722 | 0.07 |
| gCARD11_3 | CTTCATCTTGTAGTACCGCTC | 723 | 0.08 |

TABLE 19

Tested crRNAs Targeting Human CD247 gene

| crRNA | Spacer Sequence | SEQ ID NO | % Indel |
|---|---|---|---|
| gCD247_1 | TGTGTTGCAGTTCAGCAGGAG | 724 | 55.77 |
| gCD247_2 | CGTTATAGAGCTGGTTCTGGC | 725 | 0.20 |
| gCD247_3 | CGGAGGGTCTACGGCGAGGCT | 726 | 20.79 |
| gCD247_4 | TTATCTGTTATAGGAGCTCAA | 727 | 12.31 |
| gCD247_5 | TCTGTTATAGGAGCTCAATCT | 728 | 0.24 |
| gCD247_6 | TCCAAAACATCGTACTCCTCT | 729 | 0.34 |
| gCD247_7 | CCCCCATCTCAGGGTCCCGGC | 730 | 6.43 |
| gCD247_8 | GACAAGAGACGTGGCCGGGAC | 731 | 40.95 |
| gCD247_9 | TCTCCCTCTAACGTCTTCCCG | 732 | 4.13 |
| gCD247_10 | CTGAGGGTTCTTCCTTCTCTG | 733 | 0.05 |
| gCD247_11 | CCGTTGTCTTTCCTAGCAGAG | 734 | 1.18 |
| gCD247_12 | CTAGCAGAGAAGGAAGAACCC | 735 | 70.64 |
| gCD247_13 | TGCAGTTCCTGCAGAAGAGGG | 736 | 4.93 |
| gCD247_14 | TGCAGGAACTGCAGAAAGATA | 737 | 2.91 |
| gCD247_15 | ATCCCAATCTCACTGTAGGCC | 738 | 31.12 |
| gCD247_16 | CATCCCAATCTCACTGTAGGC | 739 | 0.10 |
| gCD247_17 | CTCATTTCACTCCCAAACAAC | 740 | 0.30 |
| gCD247_18 | TCATTTCACTCCCAAACAACC | 741 | 44.34 |
| gCD247_19 | ACTCCCAAACAACCAGCGCCG | 742 | 43.17 |
| gCD247_20 | TTTTCTGATTTGCTTTCACGC | 743 | 0.10 |
| gCD247_21 | TGATTTGCTTTCACGCCAGGG | 744 | 5.23 |

TABLE 19-continued

Tested crRNAs Targeting Human CD247 gene

| crRNA | Spacer Sequence | SEQ ID NO | % Indel |
|---|---|---|---|
| gCD247_22 | CTTTCACGCCAGGGTCTCAGT | 745 | 8.24 |
| gCD247_23 | ACGCCAGGGTCTCAGTACAGC | 746 | 0.30 |

TABLE 20

Tested crRNAs Targeting Human IL7R Gene

| crRNA | Spacer Sequence | SEQ ID NO | % Indel |
|---|---|---|---|
| gIL7R_1 | CTTTCCAGGGGAGATGGATCC | 747 | 0.25 |
| gIL7R_2 | CCAGGGGAGATGGATCCTATC | 748 | 8.35 |
| gIL7R_3 | CAGGGGAGATGGATCCTATCT | 749 | 87.87 |
| gIL7R_4 | CTAACCATCAGCATTTTGAGT | 750 | 0.11 |
| gIL7R_5 | GAGTTTTTTCTCTGTCGCTCT | 751 | 0.07 |
| gIL7R_6 | AGTTTTTTCTCTGTCGCTCTG | 752 | 0.06 |
| gIL7R_7 | TCTGTCGCTCTGTTGGTCATC | 753 | 2.61 |
| gIL7R_8 | CATAACACACAGGCCAAGATG | 754 | 25.83 |

TABLE 21

Tested crRNAs Targeting Human LCK Gene

| crRNA | Spacer Sequence | SEQ ID NO | % Indel |
|---|---|---|---|
| gLCK1_1 | ATGTCCTTTCACCCATCAACC | 755 | 0.06 |
| gLCK1_2 | CACCCATCAACCCGTAGGGAT | 756 | 0.17 |
| gLCK1_3 | ACCCATCAACCCGTAGGGATG | 757 | 16.21 |

TABLE 22

Tested crRNAs Targeting Human PLCG1 Gene

| crRNA | Spacer Sequence | SEQ ID NO | % Indel |
|---|---|---|---|
| gPLCG1_1 | CTCATACACCACGAAGCGCAG | 758 | 0.09 |
| gPLCG1_2 | CCTTTCTGCGCTTCGTGGTGT | 759 | 5.14 |
| gPLCG1_3 | CTGCGCTTCGTGGTGTATGAG | 760 | 0.05 |
| gPLCG1_4 | TGCGCTTCGTGGTGTATGAGG | 761 | 1.91 |
| gPLCG1_5 | GTGGTGTATGAGGAAGACATG | 762 | 3.53 |

TABLE 23

Tested crRNAs Targeting Certain Other Human Genes

| crRNA | Spacer Sequence | SEQ ID NO | % Indel |
|---|---|---|---|
| gDHODH_1 | TTGCAGAAGCGGGCCCAGGAT | 770 | 0.60 |
| gDHODH_2 | TTGCAGAAGCGGGCCCAGGAT | 771 | 0.59 |
| gDHODH_3 | TATGCTGAACACCTGATGCCG | 772 | 74.94 |
| gPLK1_1 | CCAGGGTCGGCCGGTGCCCGT | 773 | 29.06 |
| gPLK1_2 | GCCGGTGGAGCCGCCGCCGGA | 774 | 2.01 |
| gPLK1_3 | TGGGCAAGGGCGGCTTTGCCA | 775 | 2.26 |
| gPLK1_4 | GGGCAAGGGCGGCTTTGCCAA | 776 | 28.24 |
| gPLK1_5 | GGCAAGGGCGGCTTTGCCAAG | 777 | 28.41 |
| gPLK1_6 | CCAAGTGCTTCGAGATCTCGG | 778 | 2.07 |
| gPLK1_7 | CATGGACATCTTCTCCCTCTG | 779 | 90.07 |
| gPLK1_8 | TCGAGGACAACGACTTCGTGT | 780 | 0.16 |
| gPLK1_9 | CGAGGACAACGACTTCGTGTT | 781 | 6.84 |
| gPLK1_10 | GAGGACAACGACTTCGTGTTC | 782 | 8.52 |
| gMVD_1 | GAGTTAAAAACGAGCACAACA | 783 | 1.42 |
| gMVD_2 | GCTGAATGGCCGGGAGGAGGA | 784 | 14.06 |
| gMVD_3 | TGGAGTGGCAGATGGGAGAGC | 785 | 63.22 |
| gTUBB_1 | AACCATGAGGGAAATCGTGCA | 786 | 2.61 |
| gTUBB_2 | ACCATGAGGGAAATCGTGCAC | 787 | 68.40 |
| gTUBB_3 | TTCTCTGTAGGTGGCAAATAT | 788 | 18.67 |
| gU6_1 | GTCCTTTCCACAAGATATATA | 763 | 68.1 |
| gU6_2 | GATTTCTTGGCTTTATATATC | 764 | 0.71 |
| gU6_3 | TTGGCTTTATATATCTTGTGG | 765 | 2.83 |
| gU6_4 | GCTTTATATATCTTGTGGAAA | 766 | 0.37 |
| gU6_5 | ATATATCTTGTGGAAAGGACG | 767 | 0.39 |
| gU6_6 | TATATCTTGTGGAAAGGACGA | 768 | 0.39 |
| gU6_7 | TGGAAAGGACGAAACACCGTG | 769 | 0.24 |

To provide sufficient targeting to the target nucleotide sequence, the spacer sequence can be 16 or more nucleotides in length. In certain embodiments, the spacer sequence is at least 16, 17, 18, 19, 20, 21, 22, 23, 24, 25, 26, 27, 28, 29, 30, 35, 40, 45, 50, or 75 nucleotides in length. In certain embodiments, the spacer sequence is shorter than or equal to 75, 50, 45, 40, 35, 30, 25, or 20 nucleotides in length. Shorter spacer sequence may be desirable for reducing off-target events. Accordingly, in certain embodiments, the spacer sequence is shorter than or equal to 21, 20, 19, 18, or 17 nucleotides. In certain embodiments, the spacer sequence is 17-30 nucleotides in length, e.g., 17-21, 17-22, 17-23, 17-24, 17-25, 17-30, 20-21, 20-22, 20-23, 20-24, 20-25, or 20-30 nucleotides in length. In certain embodiments, the spacer sequence is 19-22 nucleotides in length, for example 20 to 21 nucleotides in length. In certain embodiments, the spacer sequence is 21 nucleotides in length. In certain embodiments, the spacer sequence is 20 nucleotides in length.

In certain embodiments, the spacer sequence comprises a portion of a spacer sequence listed in Table 1, 2, or 3, wherein the portion is 16, 17, 18, 19, or 20 nucleotides in length. In certain embodiments, the spacer sequence comprises nucleotides 1-16, 1-17, 1-18, 1-19, or 1-20 of a spacer sequence listed in Table 1, 2, or 3. In specific embodiments, the spacer sequence consists of nucleotides 1-16, 1-17, 1-18, 1-19, or 1-20 of a spacer sequence listed in Table 1, 2, or 3.

In certain embodiments, the spacer sequence comprises a portion of a spacer sequence listed in Table 1-2 or 3, wherein the portion is 16, 17, 18, 19, or 20 nucleotides in length. In certain embodiments, the spacer sequence comprises nucleotides 1-16, 1-17, 1-18, 1-19, or 1-20 of a spacer sequence listed in Table 1, 2, or 3. In specific embodiments, the spacer sequence consists of nucleotides 1-16, 1-17, 1-18, 1-19, or 1-20 of a spacer sequence listed in any one of Tables 1-23.

In certain embodiments, the spacer sequence is 21 nucleotides in length. In certain embodiments, the spacer sequence consists of a spacer sequence shown in Table 1, 2, or 3.

In certain embodiments, the spacer sequence is 21 nucleotides in length. In certain embodiments, the spacer sequence consists of a spacer sequence shown in any one of Tables 1-23.

In certain embodiments, the spacer sequence, where it is longer than 21 nucleotides in length, comprises a spacer sequence shown in Table 1, 2, or 3 and one or more nucleotides. In certain embodiments, the one or more nucleotides are 3' to the spacer sequence shown in Table 1, 2, or 3.

In certain embodiments, the spacer sequence, where it is longer than 21 nucleotides in length, comprises a spacer sequence shown in Table 1, 2, or 3 and one or more nucleotides. In certain embodiments, the one or more nucleotides are 3' to the spacer sequence shown in any one of Tables 1-3.

In certain embodiments, the spacer sequence is at least 70%, at least 75%, at least 80%, at least 85%, at least 90%, at least 93%, at least 94%, at least 95%, at least 96%, at least 97%, at least 98%, or at least 99% complementary to the target nucleotide sequence. In certain embodiments, the spacer sequence is 100% complementary to the target nucleotide sequence in the seed region (5-10 base pairs proximal to the PAM). In certain embodiments, the spacer sequence is 100% complementary to the target nucleotide sequence. The spacer sequences listed in Tables 1-3 are designed to be 100% complementary to the wild-type sequence of the corresponding target gene. Accordingly, it is contemplated that a spacer sequence useful for targeting a gene listed in Table 1, 2, or 3 can be at least 70%, at least 75%, at least 80%, at least 85%, at least 90%, at least 93%, at least 94%, at least 95%, at least 96%, at least 97%, at least 98%, or at least 99% identical to a corresponding spacer sequence listed in Table 1, 2, or 3, or a portion thereof disclosed herein. In certain embodiments, the spacer sequence is 1, 2, 3, 4, 5, 6, 7, 8, 9, or 10 nucleotides different from a sequence listed in Table 1, 2, or 3. In certain embodiments, the spacer sequence is 100% identical to a sequence listed in Table 1, 2, or 3 in the seed region (at least 5 base pairs proximal to the PAM). It has been reported that compared to DNA binding, DNA cleavage is less tolerant to mismatches between the spacer sequence and the target nucleotide sequence (see, Klein et al. (2018) Cell Reports, 22:1413). Accordingly, in certain embodiments, a guide nucleic acid to be used with a Cas nuclease comprises a spacer sequence 100% complementary to the target nucleotide sequence. In certain embodiments, a guide nucleic acid to be used with a Cas nuclease comprises a spacer sequence listed in Table 1, 2, or 3, or a portion thereof disclosed herein.

In certain embodiments, the spacer sequence is at least 70%, at least 75%, at least 80%, at least 85%, at least 90%, at least 93%, at least 94%, at least 95%, at least 96%, at least 97%, at least 98%, or at least 99% complementary to the target nucleotide sequence. In certain embodiments, the spacer sequence is 100% complementary to the target nucleotide sequence in the seed region (at least 5 base pairs proximal to the PAM). In certain embodiments, the spacer sequence is 100% complementary to the target nucleotide sequence. The spacer sequences listed in any one of Tables 1-23 are designed to be 100% complementary to the wild-type sequence of the corresponding target gene. Accordingly, it is contemplated that a spacer sequence useful for targeting a gene listed in Table 1, 2, or 3 can be at least 70%, at least 75%, at least 80%, at least 85%, at least 90%, at least 93%, at least 94%, at least 95%, at least 96%, at least 97%, at least 98%, or at least 99% identical to a corresponding spacer sequence listed in any one of Tables 1-23, or a portion thereof disclosed herein. In certain embodiments, the spacer sequence is 1, 2, 3, 4, 5, 6, 7, 8, 9, or 10 nucleotides different from a sequence listed in any one of Tables 1-23. In certain embodiments, the spacer sequence is 100% identical to a sequence listed in any one of Tables 1-23 in the seed region (at least 5 base pairs proximal to the PAM). It has been reported that compared to DNA binding, DNA cleavage is less tolerant to mismatches between the spacer sequence and the target nucleotide sequence (see, Klein et al. (2018) Cell Reports, 22:1413). Accordingly, in certain embodiments, a guide nucleic acid to be used with a Cas nuclease comprises a spacer sequence 100% complementary to the target nucleotide sequence. In certain embodiments, a guide nucleic acid to be used with a Cas nuclease comprises a spacer sequence listed in any one of Table 1-23, or a portion thereof disclosed herein.

The present invention also provides guide nucleic acids targeting human DHODH, PLK1, MVD, TUBB, or U6 gene comprising the spacer sequences provided below in Table 25. DHODH, PLK1, MVD, and TUBB are known to be essential genes. It is contemplated that the guide nucleic acids targeting these genes, particularly the ones that edit the respective genomic locus at hight efficiency (e.g., at least 50%, at least 60%, at least 70%, at least 80%, or at least 90%), can be used as positive controls for assessing transfection efficiency and other experimental processes. The spacer sequences targeting U6 in Table 25 are designed to hybridize with the promoter region of human U6 gene and can be used to assess expression of an inserted gene from the endogenous U6 promoter.

In certain embodiments, the 3' end of the targeter stem sequence is linked by no more than 1, 2, 3, 4, 5, 6, 7, 8, 9, or 10 nucleotides to the 5' end of the spacer sequence. In certain embodiments, the targeter stem sequence and the spacer sequence are adjacent to each other, directly linked by an internucleotide bond. In certain embodiments, the targeter stem sequence and the spacer sequence are linked by one nucleotide, e.g., a uridine. In certain embodiments, the targeter stem sequence and the spacer sequence are linked by two or more nucleotides. In certain embodiments, the targeter stem sequence and the spacer sequence are linked by 1, 2, 3, 4, 5, 6, 7, 8, 9, or 10 nucleotides.

In certain embodiments, the targeter nucleic acid further comprises an additional nucleotide sequence 5' to the targeter stem sequence. In certain embodiments, the additional nucleotide sequence comprises at least 1 (e.g., at least 2, at least 3, at least 4, at least 5, at least 6, at least 7, at least 8, at least 9, at least 10, at least 15, at least 20, at least 25, at least 30, at least 35, at least 40, at least 45, or at least 50) nucleotides. In certain embodiments, the additional nucleotide sequence consists of 1, 2, 3, 4, 5, 6, 7, 8, 9, 10, 15, 20, 25, 30, 35, 40, 45, or 50 nucleotides. In certain embodiments, the additional nucleotide sequence consists of 2 nucleotides. In certain embodiments, the additional nucleotide sequence is reminiscent to the loop or a fragment thereof (e.g., one, two, three, or four nucleotides at or near the 3' end of the loop) in a crRNA of a corresponding single guide CRISPR-Cas system. It is understood that an additional nucleotide sequence 5' to the targeter stem sequence is dispensable. Accordingly, in certain embodiments, the targeter nucleic acid does not comprise any additional nucleotide 5' to the targeter stem sequence.

In certain embodiments, the targeter nucleic acid further comprises an additional nucleotide sequence containing one or more nucleotides at or near the 3' end that does not hybridize with the target nucleotide sequence. The additional nucleotide sequence may protect the targeter nucleic acid from degradation by 3'-5' exonuclease. In certain embodiments, the additional nucleotide sequence is no more than 100 nucleotides in length. In certain embodiments, the additional nucleotide sequence is no more than 90, 80, 70, 60, 50, 40, 30, 20, or 10 nucleotides in length. In certain embodiments, the additional nucleotide sequence is at least 1, 2, 3, 4, 5, 6, 7, 8, 9, 10, 15, 20, 25, 30, 35, 40, 45, or 50 nucleotides in length. In certain embodiments, the additional nucleotide sequence is 5-100, 5-50, 5-40, 5-30, 5-25, 5-20, 5-15, 5-10, 10-100, 10-50, 10-40, 10-30, 10-25, 10-20, 10-15, 15-100, 15-50, 15-40, 15-30, 15-25, 15-20, 20-100, 20-50, 20-40, 20-30, 20-25, 25-100, 25-50, 25-40, 25-30, 30-100, 30-50, 30-40, 40-100, 40-50, or 50-100 nucleotides in length.

In certain embodiments, the additional nucleotide sequence forms a hairpin with the spacer sequence. Such secondary structure may increase the specificity of the engineered, non-naturally occurring system (see, Kocak et al. (2019) NAT. BIOTECH. 37:657-66). In certain embodiments, the free energy change during the hairpin formation is greater than or equal to −20 kcal/mol, −15 kcal/mol, −14 kcal/mol, −13 kcal/mol, −12 kcal/mol, −11 kcal/mol, or −10 kcal/mol. In certain embodiments, the free energy change during the hairpin formation is greater than or equal to −5 kcal/mol, −6 kcal/mol, −7 kcal/mol, −8 kcal/mol, −9 kcal/mol, −10 kcal/mol, −11 kcal/mol, −12 kcal/mol, −13 kcal/mol, −14 kcal/mol, or −15 kcal/mol. In certain embodiments, the free energy change during the hairpin formation is in the range of −20 to −10 kcal/mol, −20 to −11 kcal/mol, −20 to −12 kcal/mol, −20 to −13 kcal/mol, −20 to −14 kcal/mol, −20 to −15 kcal/mol, −15 to −10 kcal/mol, −15 to −11 kcal/mol, −15 to −12 kcal/mol, −15 to −13 kcal/mol, −15 to −14 kcal/mol, −14 to −10 kcal/mol, −14 to −11 kcal/mol, −14 to −12 kcal/mol, −14 to −13 kcal/mol, −13 to −10 kcal/mol, −13 to −11 kcal/mol, −13 to −12 kcal/mol, −12 to −10 kcal/mol, −12 to −11 kcal/mol, or −11 to −10 kcal/mol. In other embodiments, the targeter nucleic acid does not comprise any nucleotide 3' to the spacer sequence.

In certain embodiments, the modulator nucleic acid further comprises an additional nucleotide sequence 3' to the modulator stem sequence. In certain embodiments, the additional nucleotide sequence comprises at least 1 (e.g., at least 2, at least 3, at least 4, at least 5, at least 6, at least 7, at least 8, at least 9, at least 10, at least 15, at least 20, at least 25, at least 30, at least 35, at least 40, at least 45, or at least 50) nucleotides. In certain embodiments, the additional nucleotide sequence consists of 1, 2, 3, 4, 5, 6, 7, 8, 9, 10, 15, 20, 25, 30, 35, 40, 45, or 50 nucleotides. In certain embodiments, the additional nucleotide sequence consists of 1 nucleotide (e.g., uridine). In certain embodiments, the additional nucleotide sequence consists of 2 nucleotides. In certain embodiments, the additional nucleotide sequence is reminiscent to the loop or a fragment thereof (e.g., one, two, three, or four nucleotides at or near the 5' end of the loop) in a crRNA of a corresponding single guide CRISPR-Cas system. It is understood that an additional nucleotide sequence 3' to the modulator stem sequence is dispensable. Accordingly, in certain embodiments, the modulator nucleic acid does not comprise any additional nucleotide 3' to the modulator stem sequence.

It is understood that the additional nucleotide sequence 5' to the targeter stem sequence and the additional nucleotide sequence 3' to the modulator stem sequence, if present, may interact with each other. For example, although the nucleotide immediately 5' to the targeter stem sequence and the nucleotide immediately 3' to the modulator stem sequence do not form a Watson-Crick base pair (otherwise they would constitute part of the targeter stem sequence and part of the modulator stem sequence, respectively), other nucleotides in the additional nucleotide sequence 5' to the targeter stem sequence and the additional nucleotide sequence 3' to the modulator stem sequence may form one, two, three, or more base pairs (e.g., Watson-Crick base pairs). Such interaction may affect the stability of the complex comprising the targeter nucleic acid and the modulator nucleic acid.

The stability of a complex comprising a targeter nucleic acid and a modulator nucleic acid can be assessed by the Gibbs free energy change ($\Delta G$) during the formation of the complex, either calculated or actually measured. Where all the predicted base pairing in the complex occurs between a base in the targeter nucleic acid and a base in the modulator nucleic acid, i.e., there is no intra-strand secondary structure, the $\Delta G$ during the formation of the complex correlates generally with the $\Delta G$ during the formation of a secondary structure within the corresponding single guide nucleic acid. Methods of calculating or measuring the $\Delta G$ are known in the art. An exemplary method is RNAfold (rna.tbi.univie.ac.at/cgi-bin/RNAWebSuite/RNAfold.cgi) as disclosed in Gruber et al. (2008) NUCLEIC ACIDS RES., 36 (Web Server issue): W70-W74. Unless indicated otherwise, the $\Delta G$ values in the present disclosure are calculated by RNAfold for the formation of a secondary structure within a corresponding single guide nucleic acid. In certain embodiments, the $\Delta G$ is lower than or equal to −1 kcal/mol, e.g., lower than or equal to −2 kcal/mol, lower than or equal to −3 kcal/mol, lower than or equal to −4 kcal/mol, lower than or equal to −5 kcal/mol, lower than or equal to −6 kcal/mol, lower than or equal to −7 kcal/mol, lower than or equal to −7.5 kcal/mol, or lower than or equal to −8 kcal/mol. In certain embodiments, the $\Delta G$ is greater than or equal to −10 kcal/mol, e.g., greater than or equal to −9 kcal/mol, greater than or equal to −8.5 kcal/mol, or greater than or equal to −8 kcal/mol. In certain embodiments, the $\Delta G$ is in the range of −10 to −4 kcal/mol. In certain embodiments, the $\Delta G$ is in the range of −8 to −4 kcal/mol, −7 to −4 kcal/mol, −6 to −4 kcal/mol, −5 to −4 kcal/mol, −8 to −4.5 kcal/mol, −7 to −4.5 kcal/mol, −6 to −4.5 kcal/mol, or −5 to −4.5 kcal/mol, for example −8 kcal/mol, −7 kcal/mol, −6 kcal/mol, −5 kcal/mol, −4.9 kcal/mol, −4.8 kcal/ mol, −4.7 kcal/mol, −4.6 kcal/mol, −4.5 kcal/mol, −4.4 kcal/mol, −4.3 kcal/mol, −4.2 kcal/mol, −4.1 kcal/mol, or −4 kcal/mol.

It is understood that the AG may be affected by a sequence in the targeter nucleic acid that is not within the targeter stem sequence, and/or a sequence in the modulator nucleic acid that is not within the modulator stem sequence. For example, one or more base pairs (e.g., Watson-Crick base pair) between an additional sequence 5' to the targeter stem sequence and an additional sequence 3' to the modulator stem sequence may reduce the AG, i.e., stabilize the nucleic acid complex. In certain embodiments, the nucleotide immediately 5' to the targeter stem sequence comprises a uracil or is a uridine, and the nucleotide immediately 3' to the modulator stem sequence comprises a uracil or is a uridine, thereby forming a nonconventional U-U base pair.

In certain embodiments, the modulator nucleic acid comprises a nucleotide sequence referred to herein as a "5' sequence", e.g., a tail sequence, positioned 5' to the modulator stem sequence. Where the CRISPR system is a type V-A CRISPR system, the 5' sequence, e.g., a tail sequence, in a modified dual guide system is reminiscent of the nucleotide sequence positioned 5' to the stem-loop structure of the scaffold sequence in a crRNA (the single guide). Accordingly, the 5' sequence, e.g., a tail sequence, can comprise the corresponding nucleotide sequences when a modified dual guide system is engineered from a single guide system. In certain embodiments, one or more nucleotides or internucleotide linkages at or near the 5' end of the 5' sequence, e.g., tail sequence, can be modified, e.g., chemically modified.

Without being bound by theory, it is contemplated that or near the 5' sequence, e.g., tail sequence, may participate in the formation of the CRISPR-Cas complex. For example, in certain embodiments, the 5' sequence, e.g., tail sequence, forms a pseudoknot structure with the modulator stem sequence, which is recognized by the Cas protein (see, Yamano et al. (2016) CELL, 165:949). In certain embodiments, the 5' sequence, e.g., tail sequence, is at least 3 (e.g., at least 4 or at least 5) nucleotides in length. In certain embodiments, the 5' sequence, e.g., tail sequence, is 3, 4, or 5 nucleotides in length. In certain embodiments, the nucleotide at or near the 3' end of the 5' sequence, e.g., tail sequence, comprises a uracil or is a uridine. In certain embodiments, the second nucleotide in the 5' sequence, e.g., tail sequence, the position counted from the 3' end, comprises a uracil or is a uridine. In certain embodiments, the third nucleotide in the 5' sequence, e.g., tail sequence, the position counted from the 3' end, comprises an adenine or is an adenosine. This third nucleotide may form a base pair (e.g., a Watson-Crick base pair) with a nucleotide 5' to the modulator stem sequence. Accordingly, in certain embodiments, the modulator nucleic acid comprises a uridine or a uracil-containing nucleotide 5' to the modulator stem sequence. In certain embodiments, the 5' sequence, e.g., tail sequence, comprises the nucleotide sequence of 5'-AUU-3'. In certain embodiments, the 5' sequence, e.g., tail sequence, comprises the nucleotide sequence of 5'-AAUU-3'. In certain embodiments, the 5' sequence, e.g., tail sequence, comprises the nucleotide sequence of 5'-UAAUU-3'. In certain embodiments, the 5' sequence, e.g., tail sequence, is positioned immediately 5' to the modulator stem sequence.

In certain embodiments, the targeter nucleic acid and/or the modulator nucleic acid are designed to reduce the degree of secondary structure other than the hybridization between the targeter stem sequence and the modulator stem sequence. In certain embodiments, at most 75%, 50%, 40%, 30%, 25%, 20%, 15%, 10%, 5%, 1%, or fewer of the nucleotides of the targeter nucleic acid and/or the modulator nucleic acid participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106 (1): 23-24; and P A Carr and G M Church, 2009, Nature Biotechnology 27 (12): 1151-62).

The targeter nucleic acid is directed to a specific target nucleotide sequence, and the donor template is designed to modify the target nucleotide sequence or a sequence nearby. It is understood, therefore, that association of the targeter or modulator nucleic acid with a donor template can increase editing efficiency and reduce off-targeting. In a multiplex method (e.g., as disclosed in the "Multiplex Methods" subsection of section II infra), association of a donor template with a modulator nucleic acid allows combination of a targeter nucleic acid library with a donor template library, making designs of screening or selection assays more efficient and flexible. Accordingly, in certain embodiments, the modulator nucleic acid further comprises a donor template-recruiting sequence capable of hybridizing with a donor template (see FIG. 1C). Donor templates are described in the "Donor Templates" subsection of section II infra. The donor template and donor template-recruiting sequence can be designed such that they bear sequence complementarity. In certain embodiments, the donor template-recruiting sequence is at least 90% (e.g., at least 91%, at least 92%, at least 93%, at least 94%, at least 95%, at least 96%, at least 97%, at least 98%, or at least 99%) complementary to at least a portion of the donor template. In certain embodiments, the donor template-recruiting sequence is 100% complementary to at least a portion of the donor template. In certain embodiments, where the donor template comprises an engineered sequence not homologous to the sequence to be repaired, the donor template-recruiting sequence is capable of hybridizing with the engineered sequence in the donor template. In certain embodiments, the donor template-recruiting sequence is at least 20, 25, 30, 35, 40, 45, 50, 55, 60, 65, 70, 75, 80, 85, 90, 95, or 100 nucleotides in length. In certain embodiments, the donor template-recruiting sequence is positioned at or near the 5' end of the modulator nucleic acid. In certain embodiments, the donor template-recruiting sequence is linked to the 5' sequence, e.g., tail sequence, if present, or to the modulator stem sequence, of the modulator nucleic acid through an internucleotide bond or a nucleotide linker.

In certain embodiments, a guide nucleic acid as described herein is associated with a donor template comprising a single strand oligodeoxynucleotide (ssODN).

In certain embodiments, the modulator nucleic acid further comprises an editing enhancer sequence, which increases the efficiency of gene editing and/or homology-directed repair (HDR). Exemplary editing enhancer sequences are described in Park et al. (2018) NAT. COMMUN. 9:3313. In certain embodiments, the editing enhancer sequence is positioned 5' to the 5' sequence, e.g., tail sequence, if present, or 5' to the modulator stem sequence. In certain embodiments, the editing enhancer sequence is 1-50, 4-50, 9-50, 15-50, 25-50, 1-25, 4-25, 9-25, 15-25, 1-15, 4-15, 9-15, 1-9, 4-9, or 1-4 nucleotides in length. In certain embodiments, the editing enhancer sequence is at least 1, 2, 3, 4, 5, 6, 7, 8, 9, 10, 15, 20, 25, 30, 35, 40, 45, 50, or 55 nucleotides in length. The editing enhancer sequence is designed to minimize homology to the target nucleotide sequence or any other sequence that the engineered, non-naturally occurring system may be contacted to, e.g., the genome sequence of a cell into which the engineered, non-naturally occurring system is delivered. In certain embodiments, the editing enhancer is designed to minimize the presence of hairpin structure. The editing enhancer can comprise one or more of the chemical modifications disclosed herein.

The modulator and/or targeter nucleic acids can further comprise a protective nucleotide sequence that prevents or reduces nucleic acid degradation. In certain embodiments, the protective nucleotide sequence is at least 5 (e.g., at least 10, at least 15, at least 20, at least 25, at least 30, at least 35, at least 40, at least 45, or at least 50) nucleotides in length. The length of the protective nucleotide sequence increases the time for an exonuclease to reach the 5' sequence, e.g., tail sequence, modulator stem sequence, targeter stem sequence, and/or spacer sequence, thereby protecting these portions of the modulator and/or targeter nucleic acids from degradation by an exonuclease. In certain embodiments, the protective nucleotide sequence forms a secondary structure, such as a hairpin or a tRNA structure, to reduce the speed of degradation by an exonuclease (see, for example, Wu et al. (2018) CELL. MOL. LIFE SCI., 75 (19): 3593-3607). Secondary structures can be predicted by methods known in the art, such as the online webserver RNAfold developed at University of Vienna using the centroid structure prediction algorithm (see, Gruber et al. (2008) NUCLEIC ACIDS RES., 36: W70). Certain chemical modifications, which may be present in the protective nucleotide sequence, can also prevent or reduce nucleic acid degradation, as disclosed in the "RNA Modifications" subsection.

A protective nucleotide sequence is typically located at or near the 5' end, at or near the 3' end, or at both ends, of the modulator or targeter nucleic acid. In certain embodiments, the modulator nucleic acid comprises a protective nucleotide sequence at or near the 5' end, optionally through a nucleotide linker. In certain embodiments, the modulator nucleic acid comprises a protective nucleotide sequence at or near the 3' end. In certain embodiments, the modulator nucleic acid comprises a protective nucleotide sequence at or near the 5' end. In certain embodiments, the modulator nucleic acid comprises a protective nucleotide sequence at or near the 3' end.

As described above, various nucleotide sequences can be present in the 5' portion of a modulator nucleic acid, including but not limited to a donor template-recruiting sequence, an editing enhancer sequence, a protective nucleotide sequence, and a linker connecting such sequence to the 5' sequence, e.g., tail sequence, if present, or to the modulator stem sequence. It is understood that the functions of donor template recruitment, editing enhancement, protection against degradation, and linkage are not exclusive to each other, and one nucleotide sequence can have one or more of such functions. For example, in certain embodiments, the modulator nucleic acid comprises a nucleotide sequence that is both a donor template-recruiting sequence and an editing enhancer sequence. In certain embodiments, the modulator nucleic acid comprises a nucleotide sequence that is both a donor template-recruiting sequence and a protective sequence. In certain embodiments, the modulator nucleic acid comprises a nucleotide sequence that is both an editing enhancer sequence and a protective sequence. In certain embodiments, the modulator nucleic acid comprises a nucleotide sequence that is a donor template-recruiting sequence, an editing enhancer sequence, and a protective sequence. In certain embodiments, the nucleotide sequence 5' to the 5' sequence, e.g., tail sequence, if present, or 5' to the modulator stem sequence is 1-90, 1-80, 1-70, 1-60, 1-50, 1-40, 1-30, 1-20, 1-10, 10-90, 10-80, 10-70, 10-60, 10-50, 10-40, 10-30, 10-20, 20-90, 20-80, 20-70, 20-60, 20-50, 20-40, 20-30, 30-90, 30-80, 30-70, 30-60, 30-50, 30-40, 40-90, 40-80, 40-70, 40-60, 40-50, 50-90, 50-80, 50-70, 50-60, 60-90, 60-80, 60-70, 70-90, 70-80, or 80-90 nucleotides in length.

In certain embodiments, the engineered, non-naturally occurring system further comprises one or more compounds (e.g., small molecule compounds) that enhance HDR and/or inhibit NHEJ. Exemplary compounds having such functions are described in Maruyama et al. (2015) NAT BIOTECHNOL. 33 (5): 538-42; Chu et al. (2015) NAT BIOTECHNOL. 33 (5): 543-48; Yu et al. (2015) CELL STEM CELL 16 (2): 142-47; Pinder et al. (2015) NUCLEIC ACIDS RES. 43 (19): 9379-92; and Yagiz et al. (2019) COMMUN. BIOL. 2:198. In certain embodiments, the engineered, non-naturally occurring system further comprises one or more compounds selected from the group consisting of DNA ligase IV antagonists (e.g., SCR7 compound, Ad4 E1B55K protein, and Ad4 E4orf6 protein), RAD51 agonists (e.g., RS-1), DNA-dependent protein kinase (DNA-PK) antagonists (e.g., NU7441 and KU0060648), β3-adrenergic receptor agonists (e.g., L755507), inhibitors of intracellular protein transport from the ER to the Golgi apparatus (e.g., brefeldin A), and any combinations thereof.

The sequences of the modulator nucleic acid and the targeter nucleic acid should be compatible with the Cas protein. Exemplary sequences that are operative with certain type V-A Cas proteins are provided in Table 24. It is understood that these sequences are merely illustrative, and other guide nucleic acid sequences may also be used with these Cas proteins.

TABLE 24

Type V-A Cas Protein and Corresponding Guide Nucleic Acid Sequences

| Cas Protein[1] | Modulator Sequence[2] | Targeter Stem Sequence | PAM[3] |
|---|---|---|---|
| MAD7 (SEQ ID NO: 1) | UAAUUUCUAC (SEQ ID NO: 15) | GUAGA (SEQ ID NO: 21) | 5' TTTN |
| MAD7 (SEQ ID NO: 1) | AUCUAC (SEQ ID NO: 791) | GUAGA (SEQ ID NO: 21) | 5' TTTN |
| MAD7 (SEQ ID NO: 1) | GGAAUUUCUAC (SEQ ID NO: 102) | GUAGA (SEQ ID NO: 21) | 5' TTTN |

TABLE 24-continued

Type V-A Cas Protein and Corresponding Guide Nucleic Acid Sequences

| Cas Protein[1] | Modulator Sequence[2] | Targeter Stem Sequence | PAM[3] |
|---|---|---|---|
| MAD7 (SEQ ID NO: 1) | UAAUUCCCAC (SEQ ID NO: 792) | GUGGG (SEQ ID NO: 22) | 5' TTTN |
| MAD2 (SEQ ID NO: 2) | AUCUAC (SEQ ID NO: 791) | GUAGA (SEQ ID NO: 21) | 5' TTTN |
| AsCpf1 (SEQ ID NO: 3) | UAAUUUCUAC (SEQ ID NO: 15) | GUAGA (SEQ ID NO: 21) | 5' TTTN |
| LbCpf1 (SEQ ID NO: 4) | UAAUUUCUAC (SEQ ID NO: 15) | GUAGA (SEQ ID NO: 21) | 5' TTTN |
| FnCpf1 (SEQ ID NO: 5) | UAAUUUCUACU (SEQ ID NO: 18) | GUAGA (SEQ ID NO: 21) | 5' TTN |
| *Prevotella bryantii* Cpf1 (SEQ ID NO: 6) | AAUUUCUAC (SEQ ID NO: 19) | GUAGA (SEQ ID NO: 21) | 5' TTTC |
| *Proteocatella sphenisci* Cpf1 (SEQ ID NO: 7) | AAUUUCUAC (SEQ ID NO: 19) | GUAGA (SEQ ID NO: 21) | 5' TTTC |
| *Anaerovibrio sp.* RM50 Cpf1 (SEQ ID NO: 8) | AAUUUCUAC (SEQ ID NO: 19) | GUAGA (SEQ ID NO: 21) | 5' TTTC |
| *Moraxella caprae* Cpf1 (SEQ ID NO: 9) | GAAUUUCUAC (SEQ ID NO: 20) | GUAGA (SEQ ID NO: 21) | 5' TTTC |
| *Lachnospiraceae bacterium* COE1 Cpf1 (SEQ ID NO: 10) | GAAUUUCUAC (SEQ ID NO: 20) | GUAGA (SEQ ID NO: 21) | 5' TTTC |
| *Eubacterium coprostanoligenes* Cpf1 (SEQ ID NO: 11) | GAAUUUCUAC (SEQ ID NO: 20) | GUAGA (SEQ ID NO: 21) | 5' TTTC |
| *Smithella sp.* SCADC Csm1 (SEQ ID NO: 12) | GAAUUUCUAC (SEQ ID NO: 20) | GUAGA (SEQ ID NO: 21) | 5' TTTC |
| *Sulfuricurvum sp.* Csm1 (SEQ ID NO: 13) | GAAUUUCUAC (SEQ ID NO: 20) | GUAGA (SEQ ID NO: 21) | 5' TTTC |
| *Microgenomates* (*Roizmanbacteria*) bacterium Csm1 (SEQ ID NO: 14) | GAAUUUCUAC (SEQ ID NO: 20) | GUAGA (SEQ ID NO: 21) | 5' TTTC |

[1] The amino acid sequences of the Cas proteins are provided at the end of the specification.
[2] It is understood that a "modulator sequence" listed herein may constitute the nucleotide sequence of a modulator nucleic acid. Alternatively, additional nucleotide sequences can be comprised in the modulator nucleic acid 5' and/or 3' to a "modulator sequence" listed herein.
[3] In the consensus PAM sequences, N represents A, C, G, or T. When the PAM sequence is preceded by "5'," it means that the PAM is immediately upstream from the target nucleotide sequence when using the non-target strand (i.e., the strand not hybridized with the spacer sequence) as the coordinate.

In certain embodiments, the targeter nucleic acid of the engineered, non-naturally occurring system comprises a targeter stem sequence listed in Table 24. In certain embodiments, the targeter nucleic acid and the modulator nucleic acid of the engineered, non-naturally occurring system comprise, respectively, a targeter stem sequence and a modulator sequence listed in the same line of Table 24. It is understood that one or more 3' or 5' ends of a modulator sequence may contain chemical modifications, and/or 3' end of targeter stem sequence or 5' end of a targeter stem sequence, depending on orientation, may contain one or more chemical modifications. In certain embodiments, the engineered, non-naturally occurring system further comprises a Cas nuclease comprising the amino acid sequence set forth in the SEQ ID NO listed in the same line of Table 24. In certain embodiments, the engineered, non-naturally occurring system is useful for targeting, editing, or modifying a nucleic acid comprising a target nucleotide sequence close or adjacent to (e.g., immediately downstream of) a PAM listed in the same line of Table 24 when using the non-target strand (i.e., the strand not hybridized with the spacer sequence) as the coordinate.

In certain embodiments, the engineered, non-naturally occurring system is tunable or inducible. For example, in certain embodiments, the targeter nucleic acid, the modulator nucleic acid, and/or the Cas protein can be introduced to the target nucleotide sequence at different times, the system becoming active only when all components are present. In certain embodiments, the amounts of the targeter nucleic acid, the modulator nucleic acid, and/or the Cas protein can be titrated to achieve desirable efficiency and specificity. In certain embodiments, excess amount of a nucleic acid comprising the targeter stem sequence or the modulator stem sequence can be added to the system, thereby dissociating the complex of the targeter nucleic and modulator nucleic acid and turning off the system.

C. Cas Proteins

In certain embodiments, compositions and methods provided herein include a Cas protein, e.g., a Cas nuclease. The present invention also provides an engineered, non-naturally occurring system comprising a guide nucleic acid (e.g., a dual guide nucleic acid) disclosed herein, for example a guide nucleic acid described in section IA, IA1, and IB. In certain embodiments, the engineered, non-naturally occurring system further comprises the Cas nuclease, such as a Type I, II, III, IV, V, or VI nuclease, in some cases a Type V nuclease, for example, a Type V-A, V-C, or V-D Cas nuclease, such as a Type VA nuclease, including but not limited to a Cpf1 nuclease, derivative, or variant; a MAD nuclease, derivative, or variant; a ART nuclease, derivative, or variant; a Csm1 nuclease, derivative, or variant; or an ABW nuclease, derivative, or variant; specific examples are provided in this section. In certain embodiments, the modified guide nucleic acid and the Cas nuclease are present in a ribonucleoprotein (RNP) complex. In certain embodiments, the system also includes an editing sequence (donor sequence or donor template) having a change in sequence relative to the sequence of a target region.

The terms "CRISPR-Associated protein," "Cas protein," and "Cas," as used interchangeably herein, can include a naturally occurring Cas protein or an engineered Cas protein. Non-limiting examples of Cas protein engineering includes but are not limited to mutations and modifications of the Cas protein that alter the activity of the Cas, alter the PAM specificity, broaden the range of recognized PAMs, and/or reduce the ability to modify one or more off-target loci as compared to a corresponding unmodified Cas. In certain embodiments, the altered activity of the engineered Cas comprises altered ability (e.g., specificity or kinetics) to bind the naturally occurring crRNA or engineered modified dual guide nucleic acids, altered ability (e.g., specificity or kinetics) to bind the target nucleotide sequence, altered processivity of nucleic acid scanning, and/or altered effector (e.g., nuclease) activity. A Cas protein having the nuclease activity is referred to as a "CRISPR-Associated nuclease" or "Cas nuclease," as used interchangeably herein. In certain cases, as will be clear from context, a Cas nuclease lacking nuclease activity can also be referred to as a Cas nuclease.

The Cas nuclease that a complex comprising the targeter nucleic acid and the modulator nucleic acid is capable of activating can be any suitable Cas nuclease, such as a Type I, II, III, IV, V, or VI nuclease, such as a Type V nuclease. In certain embodiments, provided herein are methods and compositions that include a modified guide nucleic acid, e.g., RNA, as described herein, for example in section IA or section IA1, and a Type I, II, III, IV, V, or VI nuclease. In certain embodiments, provided herein are methods and compositions that include a modified guide nucleic acid, e.g., RNA, as described herein, for example in section IA, IA1, or IB and a Type V, nuclease.

In certain embodiments, the Cas nuclease that a complex comprising the targeter nucleic acid and the modulator nucleic acid is capable of activating is a type V-A, type V-C, or type V-D Cas nuclease. In certain embodiments, the Cas nuclease is a type V-A nuclease. In certain embodiments, the Cas nuclease is a Type V-E nuclease. In certain embodiments, the Cas nuclease is a MAD, ART, or ABW nuclease, as described herein. In certain embodiments, provided herein are methods and compositions that include a modified guide nucleic acid, e.g., RNA, as described herein, for example in section IA, IA1, or IB, and a Type V-A, Type V-C, Type V-E, or Type V-D Cas nuclease.

In certain embodiments, a nuclease that a complex comprising the targeter nucleic acid and the modulator nucleic acid is capable of activating can be a Type V-A Cas nuclease. When a Type V-A Cas nuclease is used with a split gRNA as described herein, it may be considered a Type V-E Cas nuclease, and "Type V-A" may be considered equivalent to "Type V-E" herein in this context. In certain embodiments, the type V-A Cas nuclease comprises Cpf1 or a variant or derivative thereof, a MAD nuclease or a variant or derivative thereof, a Csm1 nuclease or a variant or derivative thereof, an ART nuclease or variant or derivative thereof, or an ABW nuclease or variant or derivative thereof. In certain embodiments, a composition comprises a Type V-A nuclease and a modified guide nucleic acid, e.g., modified dual guide RNA, as described herein, e.g., in Section IA, IA1, or IB.

In certain embodiments, the type V-A Cas nucleases comprises Cpf1 or a derivative thereof. Cpf1 proteins are known in the art and are described in U.S. Pat. Nos. 9,790,490 and 10,113,179. Cpf1 orthologs can be found in various bacterial and archaeal genomes. For example, in certain embodiments, the Cpf1 protein is derived from *Francisella novicida* U112 (Fn), *Acidaminococcus* sp. BV3L6 (As), *Lachnospiraceae bacterium* ND2006 (Lb), *Lachnospiraceae bacterium* MA2020 (Lb2), *Candidatus Methanoplasma termitum* (CMt), *Moraxella bovoculi* 237 (Mb), *Porphyromonas crevioricanis* (Pc), *Prevotella disiens* (Pd), *Francisella tularensis* 1, *Francisella tularensis* subsp. *novicida*, *Prevotella albensis*, *Lachnospiraceae bacterium* MC2017 1, *Butyrivibrio proteoclasticus*, *Peregrinibacteria bacterium* GW2011_GWA2_33_10, *Parcubacteria bacterium* GW2011_GWC2_44_17, *Smithella* sp. SCADC, *Eubacterium eligens*, *Leptospira inadai*, *Porphyromonas macacae*, *Prevotella bryantii* (Pb), *Proteocatella sphenisci* (Ps), *Anaerovibrio* sp. RM50 (As2), *Moraxella caprae* (Mc), *Lachnospiraceae bacterium* COE1 (Lb3), or *Eubacterium coprostanoligenes* (Ec).

In certain embodiments, the type V-A Cas nuclease comprises AsCpf1 or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 3. In certain embodiments, the type V-A Cas protein comprises the amino acid sequence set forth in SEQ ID NO: 3.

AsCpf1

(SEQ ID NO: 3)
MTQFEGFTNLYQVSKTLRFELIPQGKTLKHIQEQGFIEEDKARNDHYKELK

PIIDRIYKTYADQCLQLVQLDWENLSAAIDSYRKEKTEETRNALIEEQATY

RNAIHDYFIGRTDNLTDAINKRHAEIYKGLFKAELFNGKVLKQLGTVTTTE

HENALLRSFDKFTTYFSGFYENRKNVFSAEDISTAIPHRIVQDNFPKFKEN

CHIFTRLITAVPSLREHFENVKKAIGIFVSTSIEEVFSFPFYNQLLTQTQI

DLYNQLLGGISREAGTEKIKGLNEVLNLAIQKNDETAHIIASLPHRFIPLF

KQILSDRNTLSFILEEFKSDEEVIQSFCKYKTLLRNENVLETAEALFNELN

SIDLTHIFISHKKLETISSALCDHWDTLRNALYERRISELTGKITKSAKEK

VQRSLKHEDINLQEIISAAGKELSEAFKQKTSEILSHAHAALDQPLPTTLK

KQEEKEILKSQLDSLLGLYHLLDWFAVDESNEVDPEFSARLTGIKLEMEPS

LSFYNKARNYATKKPYSVEKFKLNFQMPTLASGWDVNKEKNNGAILFVKNG

LYYLGIMPKQKGRYKALSFEPTEKTSEGFDKMYYDYFPDAAKMIPKCSTQL

KAVTAHFQTHTTPILLSNNFIEPLEITKEIYDLNNPEKEPKKFQTAYAKKT

GDQKGYREALCKWIDFTRDFLSKYTKTTSIDLSSLRPSSQYKDLGEYYAEL

NPLLYHISFQRIAEKEIMDAVETGKLYLFQIYNKDFAKGHHGKPNLHTLYW

TGLFSPENLAKTSIKLNGQAELFYRPKSRMKRMAHRLGEKMLNKKLKDQKT

PIPDTLYQELYDYVNHRLSHDLSDEARALLPNVITKEVSHEIIKDRRFTSD

KFFFHVPITLNYQAANSPSKFNQRVNAYLKEHPETPIIGIDRGERNLIYIT

VIDSTGKILEQRSLNTIQQFDYQKKLDNREKERVAARQAWSVVGTIKDLKQ

GYLSQVIHEIVDLMIHYQAVVVLENLNFGFKSKRTGIAEKAVYQQFEKMLI

DKLNCLVLKDYPAEKVGGVLNPYQLTDQFTSFAKMGTQSGFLFYVPAPYTS

KIDPLTGFVDPFVWKTIKNHESRKHFLEGFDFLHYDVKTGDFILHFKMNRN

LSFQRGLPGFMPAWDIVFEKNETQFDAKGTPFIAGKRIVPVIENHRFTGRY

RDLYPANELIALLEEKGIVFRDGSNILPKLLENDDSHAIDTMVALIRSVLQ

MRNSNAATGEDYINSPVRDLNGVCFDSRFQNPEWPMDADANGAYHIALKGQ

LLLNHLKESKDLKLQNGISNQDWLAYIQELRN

In certain embodiments, the type V-A Cas nuclease comprises LbCpf1 or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 4. In certain embodiments, the type V-A Cas protein comprises the amino acid sequence set forth in SEQ ID NO: 4.

LbCpf1

(SEQ ID NO: 4)
MSKLEKFTNCYSLSKTLRFKAIPVGKTQENIDNKRLLVEDEKRAEDYKGVK

KLLDRYYLSFINDVLHSIKLKNLNNYISLFRKKTRTEKENKELENLEINLR

KEIAKAFKGNEGYKSLFKKDIIETILPEFLDDKDEIALVNSFNGFTTAFTG

FFDNRENMFSEEAKSTSIAFRCINENLTRYISNMDIFEKVDAIFDKHEVQE

IKEKILNSDYDVEDFFEGEFFNFVLTQEGIDVYNAIIGGFVTESGEKIKGL

NEYINLYNQKTKQKLPKFKPLYKQVLSDRESLSFYGEGYTSDEEVLEVFRN

TLNKNSEIFSSIKKLEKLFKNFDEYSSAGIFVKNGPAISTISKDIFGEWNV

IRDKWNAEYDDIHLKKKAVVTEKYEDDRRKSFKKIGSFSLEQLQEYADADL

SVVEKLKEIIIQKVDEIYKVYGSSEKLFDADFVLEKSLKKNDAVVAIMKDL

LDSVKSFENYIKAFFGEGKETNRDESFYGDFVLAYDILLKVDHIYDAIRNY

VTQKPYSKDKFKLYFQNPQFMGGWDKDKETDYRATILRYGSKYYLAIMDKK

YAKCLQKIDKDDVNGNYEKINYKLLPGPNKMLPKVFFSKKWMAYYNPSEDI

QKIYKNGTFKKGDMFNLNDCHKLIDFFKDSISRYPKWSNAYDFNFSETEKY

KDIAGFYREVEEQGYKVSFESASKKEVDKLVEEGKLYMFQIYNKDFSDKSH

GTPNLHTMYFKLLFDENNHGQIRLSGGAELFMRRASLKKEELVVHPANSPI

ANKNPDNPKKTTTLSYDVYKDKRFSEDQYELHIPIAINKCPKNIFKINTEV

RVLLKHDDNPYVIGIDRGERNLLYIVVVDGKGNIVEQYSLNEIINNFNGIR

IKTDYHSLLDKKEKERFEARQNWTSIENIKELKAGYISQVVHKICELVEKY

DAVIALEDLNSGFKNSRVKVEKQVYQKFEKMLIDKLNYMVDKKSNPCATGG

ALKGYQITNKFESFKSMSTQNGFIFYIPAWLTSKIDPSTGFVNLLKTKYTS

IADSKKFISSFDRIMYVPEEDLFEFALDYKNFSRTDADYIKKWKLYSYGNR

IRIFRNPKKNNVFDWEEVCLTSAYKELFNKYGINYQQGDIRALLCEQSDKA

FYSSFMALMSLMLQMRNSITGRTDVDFLISPVKNSDGIFYDSRNYEAQENA

ILPKNADANGAYNIARKVLWAIGQFKKAEDEKLDKVKIAISNKEWLEYAQT

SVKH

In certain embodiments, the type V-A Cas nuclease comprises FnCpf1 or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 5.

FnCpf1

(SEQ ID NO: 5)
MSIYQEFVNKYSLSKTLRFELIPQGKTLENIKARGLILDDEKRAKDYKKAK

QIIDKYHQFFIEEILSSVCISEDLLQNYSDVYFKLKKSDDDNLQKDFKSAK

DTIKKQISEYIKDSEKFKNLFNQNLIDAKKGQESDLILWLKQSKDNGIELF

KANSDITDIDEALEIIKSFKGWTTYFKGFHENRKNVYSSNDIPTSIIYRIV

DDNLPKFLENKAKYESLKDKAPEAINYEQIKKDLAEELTFDIDYKTSEVNQ

RVFSLDEVFEIANFNNYLNQSGITKFNTIIGGKFVNGENTKRKGINEYINL

YSQQINDKTLKKYKMSVLFKQILSDTESKSFVIDKLEDDSDVVTTMQSFYE

QIAAFKTVEEKSIKETLSLLFDDLKAQKLDLSKIYFKNDKSLTDLSQQVFD

DYSVIGTAVLEYITQQIAPKNLDNPSKKEQELIAKKTEKAKYLSLETIKLA

LEEFNKHRDIDKQCRFEEILANFAAIPMIFDEIAQNKDNLAQISIKYQNQG

KKDLLQASAEDDVKAIKDLLDQTNNLLHKLKIFHISQSEDKANILDKDEHF

YLVFEECYFELANIVPLYNKIRNYITQKPYSDEKFKLNFENSTLANGWDKN

KEPDNTAILFIKDDKYYLGVMNKKNNKIFDDKAIKENKGEGYKKIVYKLLP

```
GANKMLPKVFFSAKSIKFYNPSEDILRIRNHSTHTKNGSPQKGYEKFEFNI

EDCRKFIDFYKQSISKHPEWKDFGFRFSDTQRYNSIDEFYREVENQGYKLT

FENISESYIDSVVNQGKLYLFQIYNKDFSAYSKGRPNLHTLYWKALFDERN

LQDVVYKLNGEAELFYRKQSIPKKITHPAKEAIANKNKDNPKKESVFEYDL

IKDKRFTEDKFFFHCPITINFKSSGANKFNDEINLLLKEKANDVHILSIDR

GERHLAYYTLVDGKGNIIKQDTFNIIGNDRMKTNYHDKLAAIEKDRDSARK

DWKKINNIKEMKEGYLSQVVHEIAKLVIEYNAIVVFEDLNFGFKRGRFKVE

KQVYQKLEKMLIEKLNYLVFKDNEFDKTGGVLRAYQLTAPFETFKKMGKQT

GIIYYVPAGFTSKICPVTGFVNQLYPKYESVSKSQEFFSKFDKICYNLDKG

YFEFSFDYKNFGDKAAKGKWTIASFGSRLINFRNSDKNHNWDTREVYPTKE

LEKLLKDYSIEYGHGECIKAAICGESDKKFFAKLTSVLNTILQMRNSKTGT

ELDYLISPVADVNGNFFDSRQAPKNMPQDADANGAYHIGLKGLMLLGRIKN

NQEGKKLNLVIKNEEYFEFVQNRNN
```

In certain embodiments, the type V-A Cas nuclease comprises *Prevotella bryantii* Cpf1 (PbCpf1) or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 6. In certain embodiments, the type V-A Cas protein comprises the amino acid sequence set forth in SEQ ID NO: 6.

```
Prevotella bryantii Cpf1 (PbCpf1)
                                        (SEQ ID NO: 6)
MQINNLKIIYMKFTDFTGLYSLSKTLRFELKPIGKTLENIKKAGLLEQDQH

RADSYKKVKKIIDEYHKAFIEKSLSNFELKYQSEDKLDSLEEYLMYYSMKR

IEKTEKDKFAKIQDNLRKQIADHLKGDESYKTIFSKDLIRKNLPDFVKSDE

ERTLIKEFKDFTTYFKGFYENRENMYSAEDKSTAISHRIIHENLPKFVDNI

NAFSKIILIPELREKLNQIYQDFEEYLNVESIDEIFHLDYFSMVMTQKQIE

VYNAIIGGKSTNDKKIQGLNEYINLYNQKHKDCKLPKLKLLFKQILSDRIA

ISWLPDNFKDDQEALDSIDTCYKNLLNDGNVLGEGNLKLLLENIDTYNLKG

IFIRNDLQLTDISQKMYASWNVIQDAVILDLKKQVSRKKKESAEDYNDRLK

KLYTSQESFSIQYLNDCLRAYGKTENIQDYFAKLGAVNNEHEQTINLFAQV

RNAYTSVQAILTTPYPENANLAQDKETVALIKNLLDSLKRLQRFIKPLLGK

GDESDKDERFYGDFTPLWETLNQITPLYNMVRNYMTRKPYSQEKIKLNFEN

STLLGGWDLNKEHDNTAIILRKNGLYYLAIMKKSANKIFDKDKLDNSGDCY

EKMVYKLLPGANKMLPKVFFSKSRIDEFKPSENIIENYKKGTHKKGANFNL

ADCHNLIDFFKSSISKHEDWSKFNFHFSDTSSYEDLSDFYREVEQQGYSIS

FCDVSVEYINKMVEKGDLYLFQIYNKDFSEFSKGTPNMHTLYWNSLFSKEN

LNNIIYKLNGQAEIFFRKKSLNYKRPTHPAHQAIKNKNKCNEKKESIFDYD

LVKDKRYTVDKFQFHVPITMNFKSTGNTNINQQVIDYLRTEDDTHIIGIDR

GERHLLYLVVIDSHGKIVEQFTLNEIVNEYGGNIYRTNYHDLLDTREQNRE

KARESWQTIENIKELKEGYISQVIHKITDLMQKYHAVVVLEDLNMGFMRGR
```

```
QKVEKQVYQKFEEMLINKLNYLVNKKADQNSAGGLLHAYQLTSKFESFQKL

GKQSGFLFYIPAWNTSKIDPVTGFVNLFDTRYESIDKAKAFFGKFDSIRYN

ADKDWFEFAFDYNNFTTKAEGTRTNWTICTYGSRIRTFRNQAKNSQWDNEE

IDLTKAYKAFFAKHGINIYDNIKEAIAMETEKSFFEDLLHLLKLTLQMRNS

ITGTTTDYLISPVHDSKGNFYDSRICDNSLPANADANGAYNIARKGLMLIQ

QIKDSTSSNRFKFSPITNKDWLIFAQEKPYLND
```

In certain embodiments, the type V-A Cas nuclease comprises *Proteocatella sphenisci* Cpf1 (PsCpf1) or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 7. In certain embodiments, the type V-A Cas protein comprises the amino acid sequence set forth in SEQ ID NO: 7.

```
Proteocatella sphenisci Cpf1 (PsCpf1)
                                        (SEQ ID NO: 7)
MENFKNLYPINKTLRFELRPYGKTLENFKKSGLLEKDAFKANSRRSMQAII

DEKFKETIEERLKYTEFSECDLGNMTSKDKKITDKAATNLKKQVILSFDDE

IFNNYLKPDKNIDALFKNDPSNPVISTFKGFTTYFVNFFEIRKHIFKGESS

GSMAYRIIDENLTTYLNNIEKIKKLPEELKSQLEGIDQIDKLNNYNEFITQ

SGITHYNEIIGGISKSENVKIQGINEGINLYCQKNKVKLPRLTPLYKMILS

DRVSNSFVLDTIENDTELIEMISDLINKTEISQDVIMSDIQNIFIKYKQLG

NLPGISYSSIVNAICSDYDNNFGDGKRKKSYENDRKKHLETNVYSINYISE

LLTDTDVSSNIKMRYKELEQNYQVCKENFNATNWMNIKNIKQSEKTNLIKD

LLDILKSIQRFYDLFDIVDEDKNPSAEFYTWLSKNAEKLDFEFNSVYNKSR

NYLTRKQYSDKKIKLNFDSPTLAKGWDANKEIDNSTIIMRKFNNDRGDYDY

FLGIWNKSTPANEKIIPLEDNGLFEKMQYKLYPDPSKMLPKQFLSKIWKAK

HPTTPEFDKKYKEGRHKKGPDFEKEFLHELIDCFKHGLVNHDEKYQDVFGF

NLRNTEDYNSYTEFLEDVERCNYNLSFNKIADTSNLINDGKLYVFQIWSKD

FSIDSKGTKNLNTIYFESLFSEENMIEKMFKLSGEAEIFYRPASLNYCEDI

IKKGHHHAELKDKFDYPIIKDKRYSQDKFFFHVPMVINYKSEKLNSKSLNN

RTNENLGQFTHIIGIDRGERHLIYLTVVDVSTGEIVEQKHLDEIINTDTKG

VEHKTHYLNKLEEKSKTRDNERKSWEAIETIKELKEGYISHVINEIQKLQE

KYNALIVMENLNYGFKNSRIKVEKQVYQKFETALIKKFNYIIDKKDPETYI

HGYQLTNPITTLDKIGNQSGIVLYIPAWNTSKIDPVTGFVNLLYADDLKYK

NQEQAKSFIQKIDNIYFENGEFKFDIDFSKWNNRYSISKTKWTLTSYGTRI

QTFRNPQKNNKWDSAEYDLTEEFKLILNIDGTLKSQDVETYKKFMSLFKLM

LQLRNSVTGTDIDYMISPVTDKTGTHFDSRENIKNLPADADANGAYNIARK

GIMAIENIMNGISDPLKISNEDYLKYIQNQQE
```

In certain embodiments, the type V-A Cas nuclease comprises *Anaerovibrio* sp. RM50 Cpf1 (As2Cpf1) or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 8. In certain embodiments, the type V-A Cas protein comprises the amino acid sequence set forth in SEQ ID NO: 8.

*Anaerovibrio sp.* RM50 Cpf1 (As2Cpf1)
(SEQ ID NO: 8)
MVAFIDEFVGQYPVSKTLRFEARPVPETKKWLESDQCSVLFNDQKRNEYYG
VLKELLDDYYRAYIEDALTSFTLDKALLENAYDLYCNRDTNAFSSCCEKLR
KDLVKAFGNLKDYLLGSDQLKDLVKLKAKVDAPAGKGKKKIEVDSRLINWL
NNNAKYSAEDREKYIKAIESFEGFVTYLTNYKQARENMFSSEDKSTAIAFR
VIDQNMVTYFGNIRIYEKIKAKYPELYSALKGFEKFFSPTAYSEILSQSKI
DEYNYQCIGRPIDDADFKGVNSLINEYRQKNGIKARELPVMSMLYKQILSD
RDNSFMSEVINRNEEAIECAKNGYKVSYALFNELLQLYKKIFTEDNYGNIY
VKTQPLTELSQALFGDWSILRNALDNGKYDKDIINLAELEKYFSEYCKVLD
ADDAAKIQDKFNLKDYFIQKNALDATLPDLDKITQYKPHLDAMLQAIRKYK
LFSMYNGRKKMDVPENGIDFSNEFNAIYDKLSEFSILYDRIRNFATKKPYS
DEKMKLSFNMPTMLAGWDYNNETANGCFLFIKDGKYFLGVADSKSKNIFDF
KKNPHLLDKYSSKDIYYKVKYKQVSGSAKMLPKVVFAGSNEKIFGHLISKR
ILEIREKKLYTAAAGDRKAVAEWIDFMKSAIAIHPEWNEYFKFKFKNTAEY
DNANKFYEDIDKQTYSLEKVEIPTEYIDEMVSQHKLYLFQLYTKDFSDKKK
KKGTDNLHTMYWHGVFSDENLKAVTEGTQPIIKLNGEAEMFMRNPSIEFQV
THEHNKPIANKNPLNTKKESVFNYDLIKDKRYTERKFYFHCPITLNFRADK
PIKYNEKINRFVENNPDVCIIGIDRGERHLLYYTVINQTGDILEQGSLNKI
SGSYTNDKGEKVNKETDYHDLLDRKEKGKHVAQQAWETIENIKELKAGYLS
QVVYKLTQLMLQYNAVIVLENLNVGFKRGRTKVEKQVYQKFEKAMIDKLNY
LVFKDRGYEMNGSYAKGLQLTDKFESFDKIGKQTGCIYYVIPSYTSHIDPK
TGFVNLLNAKLRYENITKAQDTIRKFDSISYNAKADYFEFAFDYRSFGVDM
ARNEWVVCTCGDLRWEYSAKTRETKAYSVTDRLKELFKAHGIDYVGGENLV
SHITEVADKHFLSTLLFYLRLVLKMRYTVSGTENENDFILSPVEYAPGKFF
DSREATSTEPMNADANGAYHIALKGLMTIRGIEDGKLHNYGKGGENAAWFK
FMQNQEYKNNG In certain embodiments, the type V-A Cas nuclease comprises *Moraxella caprae* Cpf1 (McCpf1) or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 9. In certain embodiments, the type V-A Cas protein comprises the amino acid sequence set forth in SEQ ID NO: 9.

*Moraxella caprae* Cpf1 (McCpf1)
(SEQ ID NO: 9)
MLFQDFTHLYPLSKTMRFELKPIGKTLEHIHAKNFLSQDETMADMYQKVKA
ILDDYHRDFIADMMGEVKLTKLAEFYDVYLKFRKNPKDDGLQKQLKDLQAV
LRKEIVKPIGNGGKYKAGYDRLFGAKLFKDGKELGDLAKFVIAQEGESSPK
LAHLAHFEKFSTYFTGFHDNRKNMYSDEDKHTAITYRLIHENLPRFIDNLQ
ILATIKQKHSALYDQIINELTASGLDVSLASHLDGYHKLLTQEGITAYNTL
LGGISGEAGSRKIQGINELINSHHNQHCHKSERIAKLRPLHKQILSDGMGV
SFLPSKFADDSEMCQAVNEFYRHYADVFAKVQSLFDGFDDHQKDGIYVEHK
NLNELSKQAFGDFALLGRVLDGYYVDVVNPEFNERFAKAKTDNAKAKLTKE
KDKFIKGVHSLASLEQAIEHYTARHDDESVQAGKLGQYFKHGLAGVDNPIQ
KIHNNHSTIKGFLERERPAGERALPKIKSGKNPEMTQLRQLKELLDNALNV
AHFAKLLTTKTTLDNQDGNFYGEFGALYDELAKIPTLYNKVRDYLSQKPFS
TEKYKLNFGNPTLLNGWDLNKEKDNFGIILQKDGCYYLALLDKAHKKVFDN
APNTGKNVYQKMIYKLLPGPNKMLPKVFFAKSNLDYYNPSAELLDKYAQGT
HKKGNNFNLKDCHALIDFFKAGINKHPEWQHFGFKFSPTSSYQDLSDFYRE
VEPQGYQVKFVDINADYINELVEQGQLYLFQIYNKDFSPKAHGKPNLHTLY
FKALFSKDNLANPIYKLNGEAQIFYRKASLDMNETTIHRAGEVLENKNPDN
PKKRQFVYDIIKDKRYTQDKFMLHVPITMNFGVQGMTIKEFNKKVNQSIQQ
YDEVNVIGIDRGERHLLYLTVINSKGEILEQRSLNDITTASANGTQMTTPY
HKILDKREIERLNARVGWGEIETIKELKSGYLSHVVHQISQLMLKYNAIVV
LEDLNFGFKRGRFKVEKQIYQNFENALIKKLNHLVLKDEADDEIGSYKNAL
QLTNNFTDLKSIGKQTGFLFYVPAWNTSKIDPETGFVDLLKPRYENIAQSQ
AFFGKFDKICYNADKDYFEFHIDYAKFTDKAKNSRQIWKICSHGDKRYVYD
KTANQNKGATKGINVNDELKSLFARHHINDKQPNLVMDICQNNDKEFHKSL
IYLLKTLLALRYSNASSDEDFILSPVANDEGMFFNSALADDTQPQNADANG
AYHIALKGLWVLEQIKNSDDLNKVKLAIDNQTWLNFAQNR In certain embodiments, the type V-A Cas nuclease comprises *Lachnospiraceae bacterium* COE1 Cpf1 (Lb3Cpf1) or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 10. In certain embodiments, the type V-A Cas protein comprises the amino acid sequence set forth in SEQ ID NO: 10.

Lb3Cpf1
(SEQ ID NO: 10)
MHENNGKIADNFIGIYPVSKTLRFELKPVGKTQEYIEKHGILDEDLKRAGD
YKSVKKIIDAYHKYFIDEALNGIQLDGLKNYYELYEKKRDNNEEKEFQKIQ
MSLRKQIVKRFSEHPQYKYLFKKELIKNVLPEFTKDNAEEQTLVKSFQEFT
TYFEGFHQNRKNMYSDEEKSTAIAYRVVHQNLPKYIDNMRIFSMILNTDIR
SDLTELFNNLKTKMDITIVEEYFAIDGFNKVVNQKGIDVYNTILGAFSTDD
NTKIKGLNEYINLYNQKNKAKLPKLKPLFKQILSDRDKISFIPEQFDSDTE

-continued

```
VLEAVDMFYNRLLQFVIENEGQITISKLLTNFSAYDLNKIYVKNDTTISAI

SNDLFDDWSYISKAVRENYDSENVDKNKRAAAYEEKKEKALSKIKMYSIEE

LNFFVKKYSCNECHIEGYFERRILEILDKMRYAYESCKILHDKGLINNISL

CQDRQAISELKDFLDSIKEVQWLLKPLMIGQEQADKEEAFYTELLRIWEEL

EPITLLYNKVRNYVTKKPYTLEKVKLNFYKSTLLDGWDKNKEKDNLGIILL

KDGQYYLGIMNRRNNKIADDAPLAKTDNVYRKMEYKLLTKVSANLPRIFLK

DKYNPSEEMLEKYEKGTHLKGENFCIDDCRELIDFFKKGIKQYEDWGQFDF

KFSDTESYDDISAFYKEVEHQGYKITFRDIDETYIDSLVNEGKLYLFQIYN

KDFSPYSKGTKNLHTLYWEMLFSQQNLQNIVYKLNGNAEIFYRKASINQKD

VVVHKADLPIKNKDPQNSKKESMFDYDIIKDKRFTCDKYQFHVPITMNFKA

LGENHFNRKVNRLIHDAENMHIIGIDRGERNLIYLCMIDMKGNIVKQISLN

EIISYDKNKLEHKRNYHQLLKTREDENKSARQSWQTIHTIKELKEGYLSQV

IHVITDLMVEYNAIVVLEDLNFGFKQGRQKFERQVYQKFEKMLIDKLNYLV

DKSKGMDEDGGLLHAYQLTDEFKSFKQLGKQSGFLYYIPAWNTSKLDPTTG

FVNLFYTKYESVEKSKEFINNFTSILYNQEREYFEFLFDYSAFTSKAEGSR

LKWTVCSKGERVETYRNPKKNNEWDTQKIDLTFELKKLFNDYSISLLDGDL

REQMGKIDKADFYKKFMKLFALIVQMRNSDEREDKLISPVLNKYGAFFETG

KNERMPLDADANGAYNIARKGLWIIEKIKNTDVEQLDKVKLTISNKEWLQY

AQEHIL
```

In certain embodiments, the type V-A Cas nuclease comprises *Eubacterium coprostanoligenes* Cpf1 (EcCpf1) or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 11. In certain embodiments, the type V-A Cas protein comprises the amino acid sequence set forth in SEQ ID NO: 11.

```
Eubacterium coprostanoligenes Cpf1 (EcCpf1)
                                       (SEQ ID NO: 11)
MDFFKNDMYFLCINGIIVISKLFAYLFLMYKRGVVMIKDNFVNVYSLSKTI

RMALIPWGKTEDNFYKKFLLEEDEERAKNYIKVKGYMDEYHKNFIESALNS

VVLNGVDEYCELYFKQNKSDSEVKKIESLEASMRKQISKAMKEYTVDGVKI

YPLLSKKEFIRELLPEFLTQDEEIETLEQFNDFSTYFQGFWENRKNIYTDE

EKSTGVPYRCINDNLPKFLDNVKSFEKVILALPQKAVDELNANFNGVYNVD

VQDVFSVDYFNFVLSQSGIEKYNNIIGGYSNSDASKVQGLNEKINLYNQQI

AKSDKSKKLPLLKPLYKQILSDRSSLSFIPEKFKDDNEVLNSINVLYDNIA

ESLEKANDLMSDIANYNTDNIFISSGVAVTDISKKVFGDWSLIRNNWNDEY

ESTHKKGKNEEKFYEKEDKEFKKIKSFSVSELQRLANSDLSIVDYLVDESA

SLYADIKTAYNNAKDLLSNEYSHSKRLSKNDDAIELIKSFLDSIKNYEAFL

KPLCGTGKEESKDNAFYGAFLECFEEIRQVDAVYNKVRNHITQKPYSNDKI

KLNFQNPQFLAGWDKNKERAYRSVLLRNGEKYYLAIMEKGKSKLFEDFPED

ESSPPFEKIDYKLLPEPSKMLPKVFFATSNKDLFNPSDEILNIRATGSFKKG

DSFNLDDCHKFIDFYKASIENHPDWSKFDFDFSETNDYEDISKFFKEVSDQ

GYSIGYRKISESYLEEMVDNGSLYMFQLYNKDFSENRKSKGTPNLHTLYFK

MLFDERNLEDVVYKLSGGAEMFYRKPSIDKNEMIVHPKNQPIDNKNPNNVK

KTSTFEYDIVKDMRYTKPQFQLHLPIVLNFKANSKGYINDDVRNVLKNSED

TYVIGIDRGERNLVYACVVDGNGKLVEQVPLNVIEADNGYKTDYHKLLNDR

EEKRNEARKSWKTIGNIKELKEGYISQVVHKICQLVVKYDAVIAMEDLNSG

FVNSRKKVEKQVYQKFERMLTQKLNYLVDKKLDPNEMGGLLNAYQLTNEAT

KVRNGRQDGIIFYIPAWLTSKIDPTTGFVNLLKPKYNSVSASKEFFSKFDE

IRYNEKENYFEFSFNYDNFPKCNADFKREWTVCTYGDRIRTFRDPENNNKF

NSEVVVLNDEFKNLFVEFDIDYTDNLKEQILAMDEKSFYKKLMGLLSLTLQ

MRNSISKNVDVDYLISPVKNSNGEFYDSRNYDITSSLPCDADSNGAYNIAR

KGLWAINQIKQADDETKANISIKNSEWLQYAQNCDEV
```

In certain embodiments, the type V-A Cas nuclease is not Cpf1. In certain embodiments, the type V-A Cas nuclease is not AsCpf1.

In certain embodiments, the type V-A Cas nuclease comprises MAD1, MAD2, MAD3, MAD4, MAD5, MAD6, MAD7, MAD8, MAD9, MAD10, MAD11, MAD12, MAD13, MAD14, MAD15, MAD16, MAD17, MAD18, MAD19, or MAD20, or derivatives or variants thereof. MAD1-MAD20 are known in the art and are described in U.S. Pat. No. 9,982,279.

In certain embodiments, the type V-A Cas nuclease comprises MAD7 or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 1. In certain embodiments, the type V-A Cas protein comprises the amino acid sequence set forth in SEQ ID NO: 1.

```
MAD7
                                        (SEQ ID NO: 1)
MNNGTNNFQNFIGISSLQKTLRNALIPTETTQQFIVKNGIIKEDELRGENR

QILKDIMDDYYRGFISETLSSIDDIDWTSLFEKMEIQLKNGDNKDTLIKEQ

TEYRKAIHKKFANDDRFKNMFSAKLISDILPEFVIHNNNYSASEKEEKTQV

IKLFSRFATSFKDYFKNRANCFSADDISSSSCHRIVNDNAEIFFSNALVYR

RIVKSLSNDDINKISGDMKDSLKEMSLEEIYSYEKYGEFITQEGISFYNDI

CGKVNSFMNLYCQKNKENKNLYKLQKLHKQILCIADTSYEVPYKFESDEEV

YQSVNGFLDNISSKHIVERLRKIGDNYNGYNLDKIYIVSKFYESVSQKTYR

DWETINTALEIHYNNILPGNGKSKADKVKKAVKNDLQKSITEINELVSNYK

LCSDDNIKAETYTHEISHILNNFEAQELKYNPEIHLVESELKASELKNVLD

VIMNAFHWCSVFMTEELVDKDNNFYAELEETYDETYPVISLYNLVRNYVTQ

KPYSTKKIKLNFGIPTLADGWSKSKEYSNNAIILMRDNLYYLGIFNAKNKP

DKKIIEGNTSENKGDYKKMIYNLLPGPNKMIPKVFLSSKTGVETYKPSAYI

LEGYKQNKHIKSSKDFDITFCHDLIDYFKNCIAIHPEWKNFGFDFSDTSTY
```

EDISGFYREVELQGYKIDWTYISEKDIDLLQEKGQLYLFQIYNKDFSKKST
GNDNLHTMYLKNLFSEENLKDIVLKLNGEAEIFFRKSSIKNPIIHKKGSIL
VNRTYEAEEKDQFGNIQIVRKNIPENIYQELYKYFNDKSDKELSDEAAKLK
NVVGHHEAATNIVKDYRYTYDKYFLHMPITINFKANKTGFINDRILQYIAK
EKDLHVIGIDRGERNLIYVSVIDTCGNIVEQKSFNIVNGYDYQIKLKQQEG
ARQIARKEWKEIGKIKEIKEGYLSLVIHEISKMVIKYNAIIAMEDLSYGFK
KGRFKVERQVYQKFETMLINKLNYLVFKDISITENGGLLKGYQLTYIPDKL
KNVGHQCGCIFYVPAAYTSKIDPTTGFVNIFKFKDLTVDAKREFIKKFDSI
RYDSEKNLFCFTFDYNNFITQNTVMSKSSWSVYTYGVRIKRRFVNGRFSNE
SDTIDITKDMEKTLEMTDINWRDGHDLRQDIIDYEIVQHIFEIFRLTVQMR
NSLSELEDRDYDRLISPVLNENNIFYDSAKAGDALPKDADANGAYCIALKG
LYEIKQITENWKEDGKFSRDKLKISNKDWFDFIQNKRYL

In certain embodiments, the type V-A Cas nuclease comprises MAD2 or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 2. In certain embodiments, the type V-A Cas protein comprises the amino acid sequence set forth in SEQ ID NO: 2

MAD2
(SEQ ID NO: 2)
MSSLTKFTNKYSKQLTIKNELIPVGKTLENIKENGLIDGDEQLNENYQKAK
IIVDDFLRDFINKALNNTQIGNWRELADALNKEDEDNIEKLQDKIRGIIVS
KFETFDLFSSYSIKKDEKIIDDDNDVEEEELDLGKKTSSFKYIFKKNLFKL
VLPSYLKTTNQDKLKIISSFDNFSTYFRGFFENRKNIFTKKPISTSIAYRI
VHDNFPKFLDNIRCFNVWQTECPQLIVKADNYLKSKNVIAKDKSLANYFTV
GAYDYFLSQNGIDFYNNIIGGLPAFAGHEKIQGLNEFINQECQKDSELKSK
LKNRHAFKMAVLFKQILSDREKSFVIDEFESDAQVIDAVKNFYAEQCKDNN
VIFNLLNLIKNIAFLSDDELDGIFIEGKYLSSVSQKLYSDWSKLRNDIEDS
ANSKQGNKELAKKIKTNKGDVEKAISKYEFSLSELNSIVHDNTKFSDLLSC
TLHKVASEKLVKVNEGDWPKHLKNNEEKQKIKEPLDALLEIYNTLLIFNCK
SFNKNGNFYVDYDRCINELSSVVYLYNKTRNYCTKKPYNTDKFKLNFNSPQ
LGEGFSKSKENDCLTLLFKKDDNYYVGIIRKGAKINFDDTQAIADNTDNCI
FKMNYFLLKDAKKFIPKCSIQLKEVKAHFKKSEDDYILSDKEKFASPLVIK
KSTFLLATAHVKGKKGNIKKFQKEYSKENPTEYRNSLNEWIAFCKEFLKTY
KAATIFDITTLKKAEEYADIVEFYKDVDNLCYKLEFCPIKTSFIENLIDNG
DLYLFRINNKDFSSKSTGTKNLHTLYLQAIFDERNLNNPTIMLNGGAELFY
RKESIEQKNRITHKAGSILVNKVCKDGTSLDDKIRNEIYQYENKFIDTLSD
EAKKVLPNVIKKEATHDITKDKRFTSDKFFFHCPLTINYKEGDTKQFNNEV
LSFLRGNPDINIIGIDRGERNLIYVTVINQKGEILDSVSFNTVTNKSSKIE
QTVDYEEKLAVREKERIEAKRSWDSISKIATLKEGYLSAIVHEICLLMIKH

NAIVVLENLNAGFKRIRGGLSEKSVYQKFEKMLINKLNYFVSKKESDWNKP
SGLLNGLQLSDQFESFEKLGIQSGFIFYVPAAYTSKIDPTTGFANVLNLSK
VRNVDAIKSFFSNFNEISYSKKEALFKFSFDLDSLSKKGFSSFVKFSKSKW
NVYTFGERIIKPKNKQGYREDKRINLTFEMKKLLNEYKVSFDLENNLIPNL
TSANLKDTFWKELFFIFKTTLQLRNSVTNGKEDVLISPVKNAKGEFFVSGT
HNKTLPQDCDANGAYHIALKGLMILERNNLVREEKDTKKIMAISNVDWFEY
VQKRRGVL

In certain embodiments, the type V-A Cas nucleases comprises Csm1. Csm1 proteins are known in the art and are described in U.S. Pat. No. 9,896,696. Csm1 orthologs can be found in various bacterial and archaeal genomes. For example, in certain embodiments, the Csm1 protein is derived from *Smithella* sp. SCADC (Sm), *Sulfuricurvum* sp. (Ss), or *Microgenomates* (*Roizmanbacteria*) *bacterium* (Mb).

In certain embodiments, the type V-A Cas nuclease comprises SmCsm1 or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 12. In certain embodiments, the type V-A Cas protein comprises the amino acid sequence set forth in SEQ ID NO: 12.

*Smithella* sp. SCADC Csm1
(SEQ ID NO: 12)
MEKYKITKTIRFKLLPDKIQDISRQVAVLQNSTNAEKKNNLLRLVQRGQEL
PKLLNEYIRYSDNHKLKSNVTVHFRWLRLFTKDLFYNWKKDNTEKKIKISD
VVYLSHVFEAFLKEWESTIERVNADCNKPEESKTRDAEIALSIRKLGIKHQ
LPFIKGFVDNSNDKNSEDTKSKLTALLSEFEAVLKICEQNYLPSQSSGIAI
AKASFNYYTINKKQKDFEAEIVALKKQLHARYGNKKYDQLLRELNLIPLKE
LPLKELPLIEFYSEIKKRKSTKKSEFLEAVSNGLVFDDLKSKFPLFQTESN
KYDEYLKLSNKITQKSTAKSLLSKDSPEAQKLQTEITKLKKNRGEYFKKAF
GKYVQLCELYKEIAGKRGKLKGQIKGIENERIDSQRLQYWALVLEDNLKHS
LILIPKEKTNELYRKVWGAKDDGASSSSSSTLYYFESMTYRALRKLCFGIN
GNTFLPEIQKELPQYNQKEFGEFCFHKSNDDKEIDEPKLISFYQSVLKTDF
VKNTLALPQSVFNEVAIQSFETRQDFQIALEKCCYAKKQIISESLKKEILE
NYNTQIFKITSLDLQRSEQKNLKGHTRIWNRFWTKQNEEINYNLRLNPEIA
IVWRKAKKTRIEKYGERSVLYEPEKRNRYLHEQYTLCTTVTDNALNNEITF
AFEDTKKKGTEIVKYNEKINQTLKKEFNKNQLWFYGIDAGEIELATLALMN
KDKEPQLFTVYELKKLDFFKHGYIYNKERELVIREKPYKAIQNLSYFLNEE
LYEKTFRDGKFNETYNELFKEKHVSAIDLTTAKVINGKIILNGDMITFLNL
RILHAQRKIYEELIENPHAELKEKDYKLYFEIEGKDKDIYISRLDFEYIKP
YQEISNYLFAYFASQQINEAREEEQINQTKRALAGNMIGVIYYLYQKYRGI
ISIEDLKQTKVESDRNKFEGNIERPLEWALYRKFQQEGYVPPISELIKLRE -continued

LEKFPLKDVKQPKYENIQQFGIIKFVSPEETSTTCPKCLRRFKDYDKNKQE

GFCKCQCGFDTRNDLKGFEGLNDPDKVAAFNIAKRGFEDLQKYK

In certain embodiments, the type V-A Cas nuclease comprises SsCsm1 or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 13. In certain embodiments, the type V-A Cas protein comprises the amino acid sequence set forth in SEQ ID NO: 13.

*Sulfuricurvum sp.* Csm1
(SEQ ID NO: 13)
MLHAFTNQYQLSKTLRFGATLKEDEKKCKSHEELKGFVDISYENMKSSATI

AESLNENELVKKCERCYSEIVKFHNAWEKIYYRTDQIAVYKDFYRQLSRKA

RFDAGKQNSQLITLASLCGMYQGAKLSRYITNYWKDNITRQKSFLKDFSQQ

LHQYTRALEKSDKAHTKPNLINFNKTFMVLANLVNEIVIPLSNGAISFPNI

SKLEDGEESHLIEFALNDYSQLSELIGELKDAIATNGGYTPFAKVTLNHYT

AEQKPHVFKNDIDAKIRELKLIGLVETLKGKSSEQIEEYFSNLDKFSTYND

RNQSVIVRTQCFKYKPIPFLVKHQLAKYISEPNGWDEDAVAKVLDAVGAIR

SPAHDYANNQEGFDLNHYPIKVAFDYAWEQLANSLYTTVTFPQEMCEKYLN

SIYGCEVSKEPVFKFYADLLYIRKNLAVLEHKNNLPSNQEEFICKINNTFE

NIVLPYKISQFETYKKDILAWINDGHDHKKYTDAKQQLGFIRGGLKGRIKA

EEVSQKDKYGKIKSYYENPYTKLTNEFKQISSTYGKTFAELRDKFKEKNEI

TKITHFGIIIEDKNRDRYLLASELKHEQINHVSTILNKLDKSSEFITYQVK

SLTSKTLIKLIKNHTTKKGAISPYADFHTSKTGFNKNEIEKNWDNYKREQV

LVEYVKDCLTDSTMAKNQNWAEFGWNFEKCNSYEDIEHEIDQKSYLLQSDT

ISKQSIASLVEGGCLLLPIINQDITSKERKDKNQFSKDWNHIFEGSKEFRL

HPEFAVSYRTPIEGYPVQKRYGRLQFVCAFNAHIVPQNGEFINLKKQIENF

NDEDVQKRNVTEFNKKVNHALSDKEYVVIGIDRGLKQLATLCVLDKRGKIL

GDFEIYKKEFVRAEKRSESHWEHTQAETRHILDLSNLRVETTIEGKKVLVD

QSLTLVKKNRDTPDEEATEENKQKIKLKQLSYIRKLQHKMQTNEQDVLDLI

NNEPSDEEFKKRIEGLISSFGEGQKYADLPINTMREMISDLQGVIARGNNQ

TEKNKIIELDAADNLKQGIVANMIGIVNYIFAKYSYKAYISLEDLSRAYGG

AKSGYDGRYLPSTSQDEDVDFKEQQNQMLAGLGTYQFFEMQLLKKLQKIQS

DNTVLRFVPAFRSADNYRNILRLEETKYKSKPFGVVHFIDPKFTSKKCPVC

SKTNVYRDKDDILVCKECGFRSDSQLKERENNIHYIHNGDDNGAYHIALKS

VENLIQMK

In certain embodiments, the type V-A Cas nuclease comprises MbCsm1 or a variant thereof. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence set forth in SEQ ID NO: 14. In certain embodiments, the type V-A Cas protein comprises the amino acid sequence set forth in SEQ ID NO: 14.

*Microgenomates (Roizmanbacteria) bacterium* Csm1
(SEQ ID NO: 14)
MEIQELKNLYEVKKTVRFELKPSKKKIFEGGDVIKLQKDFEKVQKFFLDIF

VYKNEHTKLEFKKKREIKYTWLRTNTKNEFYNWRGKSDTGKNYALNKIGFL

AEEILRWLNEWQELTKSLKDLTQREEHKQERKSDIAFVLRNFLKRQNLPFI

KDFFNAVIDIQGKQGKESDDKIRKFREEIKEIEKNLNACSREYLPTQSNGV

LLYKASFSYYTLNKTPKEYEDLKKEKESELSSVLLKEIYRRKRFNRTTNQK

DTLFECTSDWLVKIKLGKDIYEWTLDEAYQKMKIWKANQKSNFIEAVAGDK

LTHQNFRKQFPLFDASDEDFETFYRLTKALDKNPENAKKIAQKRGKFFNAP

NETVQTKNYHELCELYKRIAVKRGKIIAEIKGIENEEVQSQLLTHWAVIAE

ERDKKFIVLIPRKNGGKLENHKNAHAFLQEKDRKEPNDIKVYHFKSLTLRS

LEKLCFKEAKNTFAPEIKKETNPKIWFPTYKQEWNSTPERLIKFYKQVLQS

NYAQTYLDLVDFGNLNTFLETHFTTLEEFESDLEKTCYTKVPVYFAKKELE

TFADEFEAEVFEITTRSISTESKRKENAHAEIWRDFWSRENEEENHITRLN

PEVSVLYRDEIKEKSNTSRKNRKSNANNRFSDPRFTLATTITLNADKKKSN

LAFKTVEDINIHIDNFNKKFSKNFSGEWVYGIDRGLKELATLNVVKFSDVK

NVFGVSQPKEFAKIPIYKLRDEKAILKDENGLSLKNAKGEARKVIDNISDV

LEEGKEPDSTLFEKREVSSIDLTRAKLIKGHIISNGDQKTYLKLKETSAKR

RIFELFSTAKIDKSSQFHVRKTIELSGTKIYWLCEWQRQDSWRTEKVSLRN

TLKGYLQNLDLKNRFENIETIEKINHLRDAITANMVGILSHLQNKLEMQGV

IALENLDTVREQSNKKMIDEHFEQSNEHVSRRLEWALYCKFANTGEVPPQI

KESIFLRDEFKVCQIGILNFIDVKGTSSNCPNCDQESRKTGSHFICNFQNN

CIFSSKENRNLLEQNLHNSDDVAAFNIAKRGLEIVKV

In certain embodiments, the type V-A Cas nuclease comprises an ART nuclease or a variant thereof. In general, such nucleases sequences have <60% AA sequence similarity to Cas12a, <60% AA sequence similarity to a positive control nuclease, and >80% query cover. In certain embodiments, the Type V-A nuclease comprises an ART1, ART2, ART3, ART4, ART5, ART6, ART7, ART8, ART9, ART10, ART11, ART12, ART13, ART14, ART15, ART16, ART17, ART18, ART19, ART20, ART21, ART22, ART23, ART24, ART25, ART26, ART27, ART28, ART28, ART30, ART31, ART32, ART33, ART34, ART35, or ART11* (i.e., ART11 L679F, i.e., ART11 wherein leucine (L) at amino acid position 679 is replaced with phenylalanine (F)) nuclease, as shown in Table 25 and Appendix A. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence designated for the individual ART nuclease as shown in Table 25 and Appendix A. In certain embodiments, provided is a nucleic acid-guided nuclease comprising a nucleic acid-guided nuclease polypeptide having at least 85% identity to an amino acid sequence represented by SEQ ID NOs: 950-984 or a nucleic acid encoding a nucleic acid-guided nuclease polypeptide comprising at least 85% identity with the polynucleotide represented by SEQ ID NOs: 808-949. In certain embodiments, provided is a nucleic acid-guided nuclease comprising a polypeptide having at least 90% identity to the amino acid sequence represented by SEQ ID NOs: 950-958, 968-970, 972, 973, 976, 978-982, or 984, wherein the polypeptide does not contain a peptide motif of YLFQIYNKDF (SEQ ID NO: 806). In certain embodiments, provided is a nucleic acid-guided nuclease comprising a nucleic acid encoding a polypeptide having at least 90% identity to nucleic acids represented by SEQ ID NOs: 808-845 wherein an encoded polypeptide does not contain a peptide motif of YLFQIYNKDF (SEQ ID NO: 806). In certain embodiments, provided is a nucleic acid-guided nuclease wherein the polypeptide comprises at least 90% identity with the amino acid sequence represented by SEQ ID NOs: 950, 951, 954, 955, 957, or 958. In certain embodiments, provided is a nucleic acid-guided nuclease, wherein the polypeptide comprises a polypeptide comprising at least 90% identity with the amino acid sequence represented by SEQ ID NO: 951.

TABLE 25

Exemplary ART nucleases

| ART Name | Protein Reference Number | SEQ ID NO corresponding to Amino Acid sequences | SEQ ID NO corresponding to nucleic acid sequence | % AA to Cpf1 (<80% desired) | % AA to positive control (<60% desired) |
|---|---|---|---|---|---|
| ART1 | WP_118425113.1 | 950 | 808 | 30.838 | 32.54 |
| ART2 | WP_137013028.1 | 951 | 812 | 34.189 | 33.07 |
| ART3 | WP_073043853.1 | 952 | 818 | 35.982 | 36.72 |
| ART4 | WP_118734405.1 | 953 | 822 | 30.519 | 51.64 |
| ART5 | WP_146683785.1 | 954 | 826 | 30.114 | 32.31 |
| ART6 | WP_117882263.1 | 955 | 830 | 29.421 | 33.49 |
| ART7 | OYP43732.1 | 956 | 834 | 26.323 | 28.64 |
| ART8 | TSC78600.1 | 957 | 838 | 25.379 | 23.01 |
| ART9 | WP_094390816.1 | 958 | 842 | 26.323 | 28.62 |
| ART10 | WP_104505765.1 | 959 | 846 | 31.291 | 32.59 |
| ART11 | WP_151622887.1 | 960 | 850 | 30.654 | 35.55 |
| ART12 | HAW84277.1 | 961 | 854 | 34.872 | 31.33 |
| ART13 | WP_119227726.1 | 962 | 858 | 34.993 | 31.55 |
| ART14 | WP_118080156.1 | 963 | 8 62 | 32.551 | 35.33 |
| ART15 | WP_046700744.1 | 964 | 866 | 31.456 | 33.92 |
| ART16 | WP_115247861.1 | 965 | 870 | 31.136 | 34.25 |
| ART17 | WP_062499108.1 | 966 | 874 | 31.136 | 34.17 |
| ART18 | WP_154326953.1 | 967 | 878 | 31.113 | 33.28 |
| ART19 | WP_117747221.1 | 968 | 882 | 30.764 | 32.47 |
| ART20 | WP_118211091.1 | 969 | 886 | 30.986 | 32.29 |
| ART21 | WP_118163031.1 | 970 | 890 | 31.134 | 32.54 |
| ART22 | WP_115006085.1 | 971 | 894 | 30.044 | 31.55 |
| ART23 | HCS95801.1 | 972 | 898 | 30.37 | 51.64 |
| ART24 | WP_089541090.1 | 973 | 902 | 30.933 | 33.11 |
| ART25 | WP_120123115.1 | 974 | 906 | 29.978 | 48.88 |
| ART26 | WP_117874294.1 | 975 | 910 | 29.904 | 48.49 |
| ART27 | WP_117951432.1 | 976 | 904 | 29.421 | 33.03 |
| ART28 | WP_108977930.1 | 977 | 918 | 32.099 | 32.69 |
| ART29 | WP_117886476.1 | 978 | 922 | 29.643 | 33.41 |
| ART30 | WP_101070975.1 | 979 | 926 | 29.027 | 32.95 |
| ART31 | WP_117949317.1 | 980 | 930 | 29.198 | 33.18 |
| ART32 | WP_118128310.1 | 981 | 934 | 29.198 | 33.18 |
| ART33 | WP_138157649.1 | 982 | 938 | 27.273 | 29.89 |
| ART34 | WP_135764749.1 | 983 | 942 | 27.004 | 25 |
| ART35 | OYP46450.1 | 984 | 946 | 26.709 | 29.51 |

In certain embodiments, the type V-A Cas nuclease comprises an ABW nuclease or a variant thereof. See International (PCT) Publication No. WO2021/108324. Exemplary amino acid and nucleic acid sequences are shown in Table 26. In certain embodiments, the Type V-A nuclease comprises an ABW1, ABW 2, ABW3, ABW4, ABW5, ABW6, ABW7, ABW8, or ABW 9 nuclease, as shown in Table 26. In certain embodiments, the type V-A Cas protein comprises an amino acid sequence at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% identical to the amino acid sequence designated for the individual ABW nuclease as shown in Table 26.

TABLE 26

Sequences of exemplary engineered ABW nucleases

| | Engineered Amino Acid Sequence | Engineered Nucleotide Sequence |
|---|---|---|
| ABW1 | MGHHHHHHSSGLVPRGSG TMAAFDKFIHQYQVSKTL RFALIPQGKTLENTKNNV LQEDDERQKNYEKVKPIL DRIYKVFAEESLKDCSVD | ATGGGCCACCATCATCATCATCATAGCAGCGGCCTG GTGCCGCGCGGCAGCGGTACCATGGCGGCGTTCGAT AAGTTCATCCATCAATATCAAGTAAGCAAAACCCTC CGTTTTGCACTTATTCCGCAGGGGAAAACCTTGGAG AATACAAAAAATAACGTACTCCAGGAAGATGATGAG |

TABLE 26-continued

Sequences of exemplary engineered ABW nucleases

| Engineered Amino Acid Sequence | Engineered Nucleotide Sequence |
|---|---|
| WNDLNACLDAYQKNPSAD KRQKVKAAQDALRDEIAG YFTGKQYANGKNKNAVKE KEQAELYKDIFSKKIFDG TVTNNKLPQVNLSAEETE LLGCFDKFTTYFVGFYQN RENVFSGEDIATAIPHRI VQDNFPKFRENCRIYQDL IKNEPALKPLLQQAAAV MAQNPKGIYQPRKSLDDI FVIPFYNHLLLQDDIDYF NQILGGISGAAGQKKIQG LNETINLFMQQHPQEADK LKKKKIRHRFIPLYKQIL SDRTSFSFIPEAFSNSQE ALDGIETFKKSLKKNDTF GALERLIQNLASLDLKYV YLSNKKVNEISQALYGEW HCIQDVLKQDFSLESLIQ INPQNSSNGFLATLTDEG KKRISQCRNVLGNPLPVK LADDQDKAQVKNQLDTLL AAVHYLEWFKADPDLETD PNFTVPFEKIWEELVPLL SLYSKVRNFVTKKPYSTA KFKLNFANPTLADGWDIH KESDNGALLFEKGGLYYL GIMNPKDKPNFKSYQGAE PYYQKMVYRFFPDCSKTI PKCSTQRKDVKKYFEDHP QATSYQIHDSKKEKFRQD FFEIPREIYELNNTTYGT GKSKYKKFQTQYYQKTQD KSGYQKALRKWIDFSKKF LQTYVSTSIFDFKGLRPS KDYQDLGEFYKDVNSRCY RVTFEKIRVQDIHEAVKN GQLYLFQLYNKDFSPKSH GLPNLHTLYWKAVFDPEN LKDPIVKLNGQAELFYRP KSNMQIIQHKTGEEIVNK KLKDGTPVPDDIYREISA YVQGKCQGNLSPEAEKWL PSVTIKKAAHDITKDRRF TEDKFFFHVPITLNYQSS GKPTAFNSQVNDFLTEHP ETNIIGIDRGERNLIYAV VITPDGKILEQKSENVIH DFDYHESLSQREKQRVAA RQAWTAIGRIKDLKEGYL SLVVHEIAQMMIKYQAVV VLENLNTGFKRVRGGISE KAVYQQFEKMLIEKLNFL VFKDRAINQEGGVLKAYQ LTDSFTSFAKLGNQSGFL FYIPSAYTSKIDPGTGFV DPFIWSHVTASEENRNEF LKGFDSLKYDAQSSAFVL HFKMKSNKQFQKNNVEGF MPEWDICFEKNEEKISLQ GSKYTAGKRIIFDSKKKQ YMECFPQNELMKALQDVG ITWNTGNDIWQDVLKQAS TDTGFRHRMINLIRSVLQ MRSSNGATGEDYINSPVM DLDGRFFDTRAGIRDLPL DADANGAYHIALKGRMVL ERIRSQKNTAIKNTDWLY AIQEERNGAPKRPAATKK AGQAKKKKASGSGAGSPK KKRKVEDPKKKRKV (SEQ ID NO: 789) | CGTCAGAAAAATTACGAAAAAGTCAAACCTATCCTT GATCGTATTTATAAGGTATTCGCTGAGGAAAGCCTG AAAGATTGCAGCGTTGACTGGAATGACCTCAATGCA TGTCTGGATGCTTACCAAAAAAATCCTAGCGCGGAT AAGCGTCAGAAGGTGAAAGCCGCGCAGGACGCGTTG CGGGACGAAATTGCCGGTTATTTTACAGGGAAACAA TACGCGAACGGGAAGAACAAAAATGCCGTTAAGGAG AAAGAGCAGGCAGAATTGTATAAGGATATCTTTAGC AAAAAGATCTTTGATGGGACCGTAACGAACAACAAA TTGCCACAGGTCAACCTTTCAGCCGAAGAAACAGAG TTATTAGGCTGTTTTGATAAATTCACAACATATTTC GTCGGCTTTTACCAGAACCGTGAGAACGTATTTTCA GGGGAGGATATTGCTACAGCTATTCCGCATCGGATC GTCCAGGATAATTTTCCTAAATTCCGGGAAAACTGT CGGATTTATCAGGACTTAATCAAAAATGAACCTGCC CTTAAACCGCTGCTTCAGCAAGCAGCGGCCGCGGTG ATGGCCCAGAATCCAAAGGGGATCTATCAACCACGT AAGAGTCTGGACGATATTTTTGTCATTCCGTTTTAT AACCATCTCCTCTTACAGGATGATATTGATTATTTC AATCAAATCTTAGGCGGCATTTCGGGGGCAGCCGGT CAGAAAAAAATCCAGGGTTTAAATGAAACAATTAAT CTGTTTATGCAACAGCACCCACAAGAAGCCGATAAG TTAAAGAAAAAAAAGATTCGTCATCGGTTTATTCCG CTGTATAAACAAATTCTCTCTGACCGTACGTCTTTC TCGTTCATCCCTGAAGCTTTTTCCAATTCTCAGGAA GCGTTAGACGGCATTGAGACATTCAAAAAGTCTCTT AAGAAGAATGACACATTCGGCGCGTTGGAGCGGCTG ATTCAAAATCTTGCTTCCCTGGACCTGAAATACGTG TATTTATCGAACAAGAAGGTCAATGAGATTTCGCAG GCATTATACGGCGAATGGCACTGCATCCAAGACGTC CTCAAGCAAGATTTCAGCCTTGAGAGCCTGATCCAG ATCAACCCACAAAATTCTAGCAATGGTTTCCTGGCC ACACTTACCGACGAAGGCAAGAACCGTATCTCCCAA TGTCGTAACGTACTGGGGAATCCTCTTCCAGTCAAG CTTGCGGATGATCAAGACAAAGCGCAAGTCAAAAAC CAATTGGATACATTACTGGCTGCTCACTATCTC GAGTGGTTCAAGGCAGATCCAGACCTGGAAACAGAC CCTAACTTCACTGTTCCTTTCGAAAAGATCTGGGAG GAATTGGTTCCTTTACTTTCACTGTACTCTAAAGTT CGGAATTTTGTTACAAAGAAGCCATATTCTACAGCT AAATTTAAACTGAACTTTGCTAACCCCGACATTAGCG GATGGGTGGGATATTCACAAGGAAAGTGATAACGGC GCGCTCCTGTTTGAAAAGGGTGGTTTGTATTACTTG GGTATCATGAACCCTAAAGATAAGCCTAATTTTAAA TCCTATCAGGGTGCAGAGCCATACTATCAGAAGATG GTGTACCGTTTTTTTCCTGACTGTTCGAAGACCATC CCAAAATGCAGCACCCAACGTAAGGATGTAAAAAAG TACTTCGAAGACCACCCTCAAGCGACCTCATACCAG ATCCACGACTCAAAGAAAGAGAAGTTTCGTCAGGAT TTTTTTGAGATCCCTCGGGAGATTTACGAGCTTAAT AACACCACATACGGCACAGGTAAGTCTAAATATAAA AAATTCCAGACCCAGTATTACCAGAAGACTCAGGAT AAGTCAGGCTATCAGAAAGCACTTCGCAAATGGATT GACTTTTCCAAAAAGTTTCTTCAAACATACGTCAGT ACTTCCATTTTTGATTTCAAAGGTCTCCGTCCTTCG AAGGATTATCAGGACTTAGGCGAGTTCTATAAAGAC GTTAATTCGCGTTGTTACCGTGTGACGTTCGAGAAA ATTCGCGTACAGGACATCCACGAAGCAGTCAAAAAT GGGCAACTGTATCTCTTCCAATTATATAATAAGGAC TTCTCACCTAAAAGCCATGGGTTGCCTAATCTTCAC ACTCTCTATTGGAAAGCCGTTTGATCCTGAGAAC TTGAAGGACCCTATCGTAAAACTTAATGGCCAAGCT GAGTTATTCTATCGGCCGAAATCCAACATGCAAATC ATCCAACATAAGACCGGGGAGGAGATTGTGAACAAA AAGCTGAAGGACGGCACCCCGGTTCCTGATGATATC TACCGCGAAATCAGTGCTTACGTCCAGGGGAAATGT CAAGGCAACTTATCCCCGGAGGCAGAGAAGTGGCTC CCAAGTGTCACAATCAAGAAAGCCGCCCATGATATC ACAAAGGATCGTCGCTTTACCGAAGATAAGTTTTTC TTTCATGTCCCTATTACACTGAACTATCAGAGTTCA GGCAAGCCGACGGCATTCAACTCGCAAGTAAACGAT TTCTTGACCGAGCACCCTGAGACAAATATCATCGGC ATTGATCGGGGTGAACGTAACTTGATTTATGCCGTT GTAATCACTCCAGATGGCAAGATTCTCGAACAGAAA |

TABLE 26-continued

Sequences of exemplary engineered ABW nucleases

| Engineered Amino Acid Sequence | Engineered Nucleotide Sequence |
|---|---|
| | TCTTTTAACGTGATCCACGACTTTGATTATCATGAA
TCCCTGTCCCAGCGGGAAAAACAGCGGGTAGCAGCG
CGTCAGGCTTGGACAGCGATTGGTCGCATCAAGGAT
CTCAAGGAAGGTTACCTGTCGCTTGTGGTGCACGAA
ATTGCTCAAATGATGATCAAATACCAAGCAGTCGTC
GTATTAGAAAACCTCAACACGGGCTTTAAGCGTGTG
CGCGGTGGTATCAGTGAGAAGGCCGTCTACCAACAG
TTCGAAAAAATGTTGATTGAAAAATTGAACTTCCTG
GTATTTAAAGATCGGGCAATCAATCAGGAAGGCGGG
GTTCTCAAAGCTTACCAGCTGACAGACTCGTTTACG
TCTTTTGCAAAGTTAGGTAACCAGTCCGGTTTCCTG
TTCTACATCCCGTCCGCCTACACCAGCAAAATCGAC
CCTGGTACGGGCTTCGTCGATCCTTTTATCTGGTCT
CACGTGACCGCTTCTGAGGAAAATCGGAATGAATTT
TTAAAGGGCTTTGATAGCTTGAAATATGACGCCCAA
TCATCCGCCTTTGTACTGCATTTCAAGATGAAATCC
AATAAGCAATTTCAGAAGAACAATGTTGAAGGTTTC
ATGCCGGAATGGGATATCTGCTTCGAGAAAAACGAG
GAAAAGATTTCCTTGCAGGGTAGTAAGTATACAGCC
GGTAAACGCATTATTTTCGACTCCAAAAAGAAGCAA
TACATGGAGTGCTTCCCGCAGAATGAGCTCATGAAA
GCACTGCAGGACGTAGGCATCACCTGGAACACGGGC
AACGATATCTGGCAGGATGTCCTTAAACAAGCGAGC
ACAGATACAGGGTTTCGTCACCGGATGATCAACCTG
ATCCGTTCAGTGCTCCAGATGCGGTCCAGTAATGGT
GCGACCGGGGAGGATTACATCAATTCACCTGTGATG
GATCTGGACGGCCGTTTTTTCGACACTCGGGCGGGG
ATTCGTGATCTGCCATTGGATGCCGACGCCAACGGC
GCATACCACATCGCTTTAAAAGGGCGTATGGTACTC
GAACGCATTCGCTCCCAAAAGAATACCGCGATTAAG
AACACTGACTGGTTATACGCAATCCAAGAGGAACGT
AACGGCGCGCCAAAAAGGCCGGCGGCCACGAAAAAG
GCCGGCCAGGCAAAAAAGAAAAAGGCTAGCGGCAGC
GGCGCCGGATCCCCAAAGAAGAAAAGGAAGGTTGAA
GACCCCAAGAAAAAGAGGAAGGTGTGATAA (SEQ
ID NO: 790) |
| ABW2 | MGHHHHHHSSGLVPRGSG
TMKEFTNQYSLTKTLRFE
LRPVGETAEKIEDFKSGG
LKQTVEKDRERTEAYKQL
KEVIDSYHRDFIEQAFAR
QQTLSEEDFKQTYQLYKE
AQKEKDGETLTKQYEHLR
KKIAAMFSKATKEWAVMG
ENNELIGKNKESKLYQWL
EKNYRAGRIEKEEFDHNA
GLIEYFEKFSTYFVGFDK
NRANMYSKEAKATAISFR
TINENMVKHFDNCQRLEK
IKSKYPDLAEELKDFEEF
FKPSYFINCMNQSGIDYY
NISAIGGKDEKDQKANMK
INLFTQKNHLKGSDKPPF
FAKLYKQILSDREKSVVI
DEFEKDSELTEALKNVFS
KDGLINEEFFTKLKSALE
NEMLPEYQGQLYIRNAFL
TKISANIWGSGSWGIIKD
AVTQAAENNFTRKSDKEK
YAKKDFYSIAELQQAIDE
YIPTLENGVQNASLIEYF
RKMNYKPRGSEEDAGLIE
EINNNLRQAGIVLNQAEL
GSGKQREENIEKIKNLLD
SVLNLERFLKPLYLEKEK
MRPKAANLNKDFCESFDP
LYEKLKTFFKLYNKVRNY
ATKKPYSKDKFKINFDTA
TLLYGWSLDKETANLSVI
FRKREKFYLGIINRYNSQ
IFNYKIAGSESEKGLERK
RSLQQKVLAEEGEDYFEK
MVYHLLLGASKTIPKCST | ATGGGCCACCATCATCATCATCATAGCAGCGGCCTG
GTGCCGCGCGGCAGCGGTACCATGAAGGAGTTTACC
AACCAATATTCCTTAACCAAGACCCTGCGGTTCGAG
TTGCGGCCAGTCGGCGAAACAGCAGAAAAGATCGAA
GATTTTAAATCGGGCGGGCTCAAGCAAACAGTGGAA
AAGGATCGTGAGCGTACAGAAGCGTATAAGCAGTTG
AAAGAGGTTATTGACTCCTATCATCGTGACTTCATT
GAGCAAGCTTTTGCGCGCCAGCAGACGCTGTCCGAG
GAGGATTTTAAACAAACATATCAACTGTACAAAGAG
GCCCAGAAAGAGAAGGATGGGGAAACATTAACAAAG
CAGTACGAGCATTTACGGAAGAAATTCAGCTATG
TTCAGCAAGGCTACGAAGGAATGGGCCGTTATGGGG
GAGAATAACGAATTGATCGGGAAAAACAAAGAGTCA
AAGTTGTATCAGTGGCTGGAAGAACTACCGCGCA
GGTCGCATCGAAAAAGAGGAATTGACCATAATGCG
GGCTTAATCGAATACTTCGAGAAATTTTCCACATAT
TTCGTAGGTTTTGACAAAAATCGTGCGAATATGTAT
TCAAAGGAGGCAAAGGCGACCGCAATTTCCTTCCGG
ACGATTAATGAGAACATGGTCAAGCATTTCGATAAT
TGCCAGCGGCTCGAGAAGATTAAATCTAAATATCCT
GATTTGGCCGAGGAGCTGAAGGATTTTGAGGAGTTT
TTTAAACCTAGCTATTTCATTAATTGTATGAATCAA
TCGGGTATCGACTACTACAATATCAGCGCGATCGGC
GGTAAGGATGAAAAGGATCAGAAAGCGAATATGAAG
ATCAACCTTTTCACGCAAAAAATCATTTAAAGGGC
AGTGATAAACCACCATTTTTTGCTAAGCTCTACAAG
CAAATTTTGAGTGACCGGGAGAAGTCCGTGGTAATC
GACGAGTTCGAAAAGGACAGCGAATTGACAGAGGCA
CTCAAAAACGTGTTTTCCAAGGACGGTTTGATCAAT
GAGGAGTTTTTTACAAAGTTAAAAAGTGCATTAGAA
AATTTATGTTGCCTGAATATCAAGGTCAACTCTAC
ATCCGTAACGCTTTCCTTACGAAGATCAGCGCAAAC
ATTTGGGCTCTGGTTCTTGGGCATCATCAAGGAC
GCAGTTACCCAGGCTGCGGAAAACAATTTCACGCGT
AAGTCTGACAAGGAAAAGTATGCCAAGAAAGACTTC
TATTCCATTGCTGAACTCCAGCAGGCTATTGATGAA
TACATTCCTACTCTGGAGAACGGGGTTCAAAACGCA |

TABLE 26-continued

Sequences of exemplary engineered ABW nucleases

| Engineered Amino Acid Sequence | Engineered Nucleotide Sequence |
|---|---|
| QLKEVKAHFQKSSEDYII QSKSFAKSLTLTKEIFDL NNLRYNTETGEISSELSD TYPKKFQKGYLTQTGDVS GYKTALHKWIDFCKEFLR CYRNTEIFTFHFKDTKEY ESLDEFLKEVDSSGYEIS FDKIKASYINEKVNAGEL YLFEIYNKDFSEYSKGKP NLHTIYWKSLFETQNLLD KTAKLNGKAEIFFRPRSI KHNDKIIHRAGETLKNKN PLNEKPSSRFDYDITKDR RFTKDKFFLHCPITLNFK QDKPVRFNEQVNLYLKDN PDVNIIGIDRGERHLLYY TLINQNGEILQQGSLNRI GEEESRPTDYHRLLDERE KQRQQARETWKAVEGIKD LKAGYLSRVVHKLAGLMV QNNAIVVLEDLNKGFKRG RFAVEKQVYQNFEKALIQ KLNYLVFKEVNSKDAPGH YLKAYQLTAPFISFEKLG TQSGFLFYVRAWNTSKID PATGFTDQIKPKYKNQKQ AKDFMSSFDSVRYNRKEN YFEFEADFEKLAQKPKGR TRWTICSYGQERYSYSPK ERKFVKHNVTQNLAELFN SEGISFDSGQCFKDEILK VEDASFFKSIIFNLRLLL KLRHTCKNAEIERDFIIS PVKGNNSSFFDSRIAEQE NITSIPQNADANGAYNIA LKGLMNLHNISKDGKAKL IKDEDWIEFVQKRKFAAA KRPAATKKAGQAKKKKAS GSGAGSPKKKRKVEDPKK KRKV (SEQ ID NO: 16) | TCACTCATCGAGTACTTTCGCAAAATGAATTACAAA CCACGCGGTTCTGAAGAAGACGCAGGCTTGATCGAA GAAATTAATAACAACCTGCGTCAGGCTGGGATCGTC CTGAATCAAGCCGAGCTGGGGTCTGGTAAGCAGCGG GAAGAGAATATTGAAAAAATTAAGAACTTATTAGAT TCGGTTTTGAATCTCGAACGTTTCTTAAAGCCACTT TACTTGGAGAAAGAGAAAATGCGTCCAAAAGCTGCT AACCTGAATAAGGATTTTTGTGAGTCATTTGATCCA CTTTACGAGAAACTGAAAACGTTTTTCAAGCTCTAC AATAAAGTACGTAACTACGCAACAAAGAAACCATAC TCAAAGGACAAATTTAAGATCAATTTTGATACCGCT ACGTTATTATATGGGTGGAGTTTGGATAAGGAAACC GCGAATCTCAGCGTCATTTTCCGTAAACGCGAAAAA TTCTATTTGGGTATCATCAACCGGTACAATAGCCAG ATTTTCAATTATAAGTTGCGGGCAGTGAGAGCGAG AAAGGGTTAGAGCGTAAGCGGTCGCTGCAGCAAAAG GTGCTTGCAGAGGAGGGTGAAGATTATTTTGAGAAA ATGGTATACCACCTGCTGCTTGGCGCGTCGAAAACT ATTCCGAAATGCTCGACACAGTTGAAAGAAGTAAAA GCACACTTTCAAAAGTCATCAGAAGATTATATTATC CAATCCAATCATTTGCAAAGTCATTAACATTAACA AAAGAGATCTTTGACTTAAATAATCTGCGGTATAAC ACAGAAACGGGCGAAATTAGTTCCGAGCTTTCTGAT ACATATCCGAAGAAGTTCCAGAAGGGGTATCTCACA CAAACAGGCGACGTTTCGGGTTACAAAACTGCTCTG CATAAGTGGATTGATTTCTGCAAAGAGTTCTTGCGT TGCTATCGTAATACGGAGATCTTCACGTTCCATTTC AAGGACACGAAGGAGTACGAGTCGTTAGATGAGTTC TTGAAAGAAGTGGATAGTTCAGGTTATGAGATTTCA TTCGATAAGATCAAAGCCTCTTATATCAACGAGAAG GTTAATGCAGGCGAGCTGTACTTGTTCGAGATCTAT AATAAAGATTTCTCCGAGTATTCCAAAGGTAAGCCA AATCTGCATACCATTTATTGGAAAAGTCTCTTCGAG ACTCAAAACTTGCTGGATAAAACAGCGAAACTCAAC GGCAAGGCAGAGATCTTCTTCCGGCCACGTTCGATC AAACACAACGACAAAATCATCCACCGTGCGGGCGAA ACACTTAAGAATAAAAACCCGCTCAATGAAAAGCCT AGTTCGCGTTTCGATTACGATATTACGAAAGATCGT CGTTTTACGAAAGACAAATTTTTTTTACACTGCCCT ATTACGTTAAACTTTAAGCAGGACAAGCCTGTTCGC TTTAATGAACAAGTCAACTTATACTTAAAAGACAAT CCAGACGTGAATATTATCGGTATCGATCGTGGTGAG CGTCACTTGCTTTATTACACTTTGATCAATCAGAAT GGTGAGATCTTACAGCAGGGTTCACTTAATCGCATT GGTGAGGAAGAATCTCGGCCTACGGACTACCATCGG TTACTCGATGAGCGTGAAAAGCAGCGTCAACAAGCA CGGGAGACGTGGAAAGCAGTAGAAGGGATTAAGGAC TTAAAAGCTGGGTATCTTTCACGGGTTGTACATAAA CTTGCAGGTTTAATGGTACAAAACAACGCAATTGTC GTTCTGGAAGATCTTAACAAGGGTTTTAAGCGCGGT CGTTTCGCTGTTGAGAAACAGGTGTACCAGAACTTC GAAAAAGCACTTATTCAAAAGCTTAACTATTTAGTG TTCAAGGAGGTCAACTCTAAAGACGCCCCTGGCCAC TATTTGAAGGCATATCAGCTTACGGCCCCTTTCATC TCGTTCGAAAAATTGGGTACTCAGAGCGGTTTCCTT TTTTATGTGCGCGCATGGAATACCTCGAAGATCGAC CCGGCGACGGGTTTTACCGACCAAATCAAACCAAAG TATAAAAACCAAAAACAAGCTAAAGACTTCATGTCA AGCTTCGACTCTGTCCGGTACAACCGCAAGGAAAAT TATTTTGAATTCGAGGCGGACTTTGAAAAACTGGCA CAGAAACCTAAGGGGCGCACCCGCTGGACGATTTGT TCCTATGGCCAGGAACGGTACTCTTACTCCCCAAAA GAACGGAAGTTTGTAAAGCACAACGTTACACAAAAT CTTGCTGAGCTTTTTAATTCAGAGGGTATCTCGTTC GACTCCGGGCAGTGTTTCAAGGATGAGATCCTGAAG GTCGAGGATGCCAGTTTCTTTAAGTCTATTATTTTC AATCTTCGCCTCCTTCTCAAGCTTCGTCACACTTGC AAGAACGCCGAGATCGAACGTGATTTCATCATTTCT CCTGTCAAGGGGAACAATTCGTCCTTTTTTGACTTC CGTATTGCCGAACAAGAAAATATCACCAGCATTCCA CAGAATGCTGATGCAAACGGTGCATACAACATCGCG CTGAAGGGCCTGATGAACCTCCATAATATCTCTAAG GACGGCAAGGCAAATTAATTAAGGATGAAGATTGG ATCGAATTTGTCCAAAAACGCAAGTTCGCGGCCGCA |

TABLE 26-continued

Sequences of exemplary engineered ABW nucleases

| Engineered Amino Acid Sequence | Engineered Nucleotide Sequence |
|---|---|
| | AAAAGGCCGGCGGCCACGAAAAAGGCCGGCCAGGCA AAAAAGAAAAAGGCTAGCGGCAGCGGCGCCGGATCC CCAAAGAAGAAAAGGAAGGTTGAAGACCCCAAGAAA AAGAGGAAGGTGTGATAA (SEQ ID NO: 17) |
| ABW3 | MGHHHHHHSSGLVPRGSL QMKTLSDFTNLFPLSKTL RFKLIPIGNTLKNIEASG ILDEDRHRAESYVKVKAI IDEYHKAFIDRVLSDTCL QTESIGKHNSLEEFFFYY QIGAKSEQQKKTFKKIQD ALRKQIADSLTKDKHFSR IDKKELIQEDLIQFVRDG EDAAEKTSLISEFQNFTV YFTGFHENRQNMYSPDEK STAIAYRLINENLPKFVD NMKVFDRIAASELASCFD ELYHNFEEYLQVERLHDI FSLDYFNLLLTQKHIDVY NALIGGKATETGEKIKGL NEYINLYNQRHKQEKLPK FKMLFKQILTDREAISWL PRQFDDNSQLLSAIEQCY NHLSTYTLKDGSLKYLLE NLHTYDTEKIFIRNDSLL TEISQRHYGSWSILPEAI KRHLERANPQKRRETYEA YQSRIEKAFKAYPGFSIA FLNGCLTETGKESPSIES YFESLGAVETETSQQENW FARIANAYTDFREMQNRL HATDVPLAQDAEAVARIK KLLDALKGLQLFIKPLLD TGEEAEKDERFYGDFTEF WNELDTITPLYNMVRNYL TRKPYSEEKIKLNFQNPT LLNGWDLNKEVDNTSVIL RRNGRYYLAIMHRNHRRV FSQYPGTERGDCYEKMEY KLLPGANKMLPKVFFSKS RIDEFNPSEELLARYQQG THKKGENFNLHDCHALID FFKDSIEKHEEWRNFHFK FSDTSSYTDMSGFYREIE TQGYKLSFVPVACEYIDE LVRDGKIFLFQIYNKDFS TYSKGKPNMHTLYWEMLF DERNLMNVVYKLNGQAEI FFRKASLSARHPEHPAGL PIKKKQAPTEESCFPYDL IKNKRYTVDQFQPHVPIT INFKATGTSNINPSVTDY IRTADDLHIIGIDRGERH LLYLVVIDSQGRICEQFS LNEIVTQYQGHQYRTDYH ALLQKKEDERQKARQSWQ SIENIKELKEGYLSQVVH KVSELMIKYKAIVVLEDL NAGFKRSRQKVEKQVYQK FEKMLIDKLNYLVFKTAE ADQPGGLLHAYQLTNKFE SFKKMGKQSGFLFYIPAW NTSKIDPTTGFVNLFDTR YENVDKSRAFFGKFDSIR YRADKGTFEWTFDYNNPH KKAEGTRSSWCLSSHGNR VRTFRNPAKNNQWDNEEI DLTQAFRDLFEAWGIEIT SNLKEAICNQSEKKFFSE LFELFKLMIQLRNSVTGT NIDYMVSPVENHYGTFFD SRTCDSSLPANADANGAY NIARKGLMLARRIQATPE | ATGGGCCACCATCATCATCATCATAGCAGCGGCCTG GTGCCGCGCGGCAGCCTGCAGATGAAGACCTTGTCT GATTTTACCAATCTGTTCCCTTTATCTAAGACTCTC CGTTTCAAGCTGATTCCAATCGGCAACACGCTCAAG AACATTGAAGCTAGTGGCATCCTTGACGAGGATCGC CACCGCGCGGAGTCCTATGTCAAGGTCAAGGCCATC ATCGACGAATATCATAAAGCTTTCATCGATCGGGTC CTGTCGGATACTTGCCTCCAGACGGAATCTATCGGC AAACACAACAGTCTCGAGGAATTCTTTTTCTACTAC CAAATTGGTGCAAAAGTGAACAGCAGAAAAGACG TTTAAAAAGATTCAAGACGCCTTGCGCAAACAAATC GCAGATAGCCTCACCAAGGACAAACATTTTTCACGG ATTGATAAAAAGAATTGATCCAAGAGGATTTGATC CAGTTTGTGCGCGATGGGAGGAGGATGCCGCTGAAAAG ACGTCTCTGATTTCCGAATTTCAAAATTTCACAGTT TATTTTACCGGGTTTCATGAGAATCGCCAGAACATG TACAGTCCGGACGAGAAGTCCACGGCCATCGCATAT CGCTTAATTAACGAGAATCTCCCAAAATTCGTAGAC AACATGAAAGTTTTTGACCGTATCGCGGCGTCCGAA TTGGCATCGTGTTTCGACGAATTATACCACAACTTC GAGGAATACCTCCAAGTGGAGCGGTTACATGATATC TTTAGTTTGGACTATTTCAATCTGCTTCTCACGCAG AAACATATCGACGTCTATAATGCTCTGATCGGTGGG AAGGCAACCGAAACCGGGGAAAAGATCAAGGGCTTA AATGAATACATCAATCTCTACAATCAACGTCACAAG CAGGAAAAACTGCCAAAATTCAAGATGTTATTCAAG CAAATTCTTACCGACCGTGAGGCAATCAGCTGGTTG CCACGCCAATTTGACGATAATAGTCAGTTACTCTCA GCCATTGAACAGTGTTATAACCACCTTTCGACCTAC ACACTCAAGGATGGGTCACTCAAATACCTGTTAGAA AACCTGCATACATACGATACTGAAAAGATCTTCATC CGCAATGACAGTTTACTTACGGAAATCTCCCAACGG CATTACGGTTCGTGGTCGATTTTACCAGAAGCTATC AAACGTCATCTCGAGCGCGCGAACCCGCAAAACGG CGCGAAACATACGAGGCCTATCAATCTCGCATTGAG AAGGCCTTTAAGGCATATCCGGGGTTTTCAATTGCT TTCCTCAATGGGTGTTTAACAGAGACAGGTAAGGAG TCGCCATCCATCGAAAGCTATTTTGAAAGTCTGGGT GCTGTCGAAACAGAGACCTCTCAGCAGGAAAACTGG TTTGCCCGCATCGCAAACGCTTATACGGACTTTCGT GAAATGCAAAATCGGCTGCACGCCACTGACGTGCCG TTGGCTCAAGACGCTGAGGCAGTGGCCCGGATCAAG AAGCTGTTAGATGCACTGAAAGGCCTGCAATTATTC ATTAAGCCTCTTTTGGATACTGGCGAAGAAGCAGAG AAAGATGAACGGTTCTATGGGACTTTACCGAATTC TGGAACGAGTTAGACACTATCACGCCATTGTACAAT ATGGTACGGAACTATCTCACGCGTAAGCCTTATAGT GAAGAAAAAATCAAGCTCAATTTCCAGAATCCGACA TTACTGAACGGTTGGGATTTGAACAAAGAGGTAGAT AATACATCTGTCATCCTCCGCCGGAATGGTCGTTAT TATCTTGCCATCATGCACCGCAACCACCGGCGTGTA TTTTCACAGTATCCAGGCACAGAACGTGGCGATTGT TATGAGAAATGGAATATAAACTGCTTCCGGGCGCC AACAGATGCTCCCAAAAGTCTTCTTCTCTAAATCA CGCATCGATGAATTCAACCCTAGCGAAGAATTATTA GCACGTTACCAGCAAGGTACCCACAAGAAGGGTGAG AATTTTAATTTACACGACTGCCATGCCTTGATTGAT TTTTTTAAAGACTCTATTGAAAACATGAAGAATGG CGTAACTTTCATTTTAAATTTAGTGATACGTCCAGT TACACCGACATGAGCGGCTTTTATCGTGAAATCGAA ACACAGGGTTACAAGTTGTCATTTGTGCCAGTGGCG TGTGAATACATCGATGAGTTGGTACGTGATGGCAAA ATCTTTTTGTTCCAGATCTATAATAAGGACTTTTCG ACCTACTCTAAGGGCAAGCCAAATATGCACACTTAT TATTGGGAAATGCTTTTCGACGAGCGGAACCTGATG AACGTGGTGTATAAACTCAATGGCCAAGCAGAGATC TTTTTTCGTAAAGCATCACTGAGCGCACGTCACCCT GAGCACCCGGCAGGGTTGCCAATTAAAAAAAAACAG GCCCCCGACGGAAGAATCTTGTTTCCCATATGATCTC |

TABLE 26-continued

Sequences of exemplary engineered ABW nucleases

| Engineered Amino Acid Sequence | Engineered Nucleotide Sequence |
|---|---|
| NDPISLTLSNKEWLRFAQ GLDETTTYEAAAKRPAAT KKAGQAKKKKASGSGAGS PKKKRKVEDPKKKRKV (SEQ ID NO: 29) | ATTAAGAATAAGCGGTATACAGTTGACCAGTTTCAG TTTCACGTGCCAATTACTATTAATTTTAAAGCAACT GGGACTTCAAATATCAACCCGTCGGTCACTGATTAT ATTCGTACGGCCGATGACCTCCATATCATTGGCATT GATCGCGGTGAGCGCCATTTACTTTATTTAGTGGTG ATTGACTCACAAGGGCGCATCTGTGAACAGTTTTCC TTAAACGAGATCGTAACGCAATACCAAGGTCACCAG TACCGTACAGATTATCATGCTCTCTTGCAGAAAAAA GAGGATGAACGGCAAAAAGCTCGCCAGTCTTGGCAA TCGATCGAAAACATCAAGGAATTAAAAGAGGGGTAT CTGAGCCAAGTAGTGCACAAGGTTTCTGAACTGATG ATCAAATATAAAGCAATTGTGGTGTTGGAAGATTTA AATGCTGGGTTCAAGCGGAGTCGGCAGAAGGTTGAA AAGCAAGTGTATCAAAAATTTGAGAAGATGCTGATC GACAAACTTAACTATCTTGTGTTCAAGACCGCAGAA GCTGACCAACCTGGCGGCCTCCTGCACGCATACCAA TTAACAAATAAATTTGAGTCATTCAAGAAAATGGGG AAGCAAAGTGGCTTCCTCTTCTACATTCCTGCATGG AACACGTCTAAAATCGACCCGACCACGGGCTTTGTC AACCTTTTTGATACCCGGTATGAGAACGTAGACAAA TCCCGTGCCTTCTTCGGCAAATTCGATAGCATCCGC TACCGTGCGGACAAGGGCACGTTCGAGTGGACGTTC GATTATAATAACTTTCACAAAAAGGCCGAAGGTACG CGGTCGAGCTGGTGTTTGTCTTCTCATGGTAACCGG GTCCGTACTTTCCGCAATCCTGCGAAAAACAACCAA TGGGACAACGAAGAGATCGACTTAACACAAGCGTTC CGCGATCTGTTTGAAGCTTGGGGGATCGAGATCACT TCGAACTTAAAAGAGGCCATTTGCAACCAGTCTGAG AAGAAATTCTTTTCTGAGCTTTTCGAACTGTTCAAA CTTATGATCCAGCTGCGGAACTCAGTGACAGGCACG AATATCGACTATATGGTGAGCCCAGTCGAGAATCAC TACGGCACGTTCTTCGATTCGCGCACATGCGATTCG TCTCTGCCGGCTAACGCTGACGCTAATGGTGCTTAT AATATTGCCCGTAAGGGGTTAATGCTGGCTCGCCGC ATTCAGGCTACCCCTGAGAATGATCCGATCTCCTTA ACATTGAGCAACAAAGAGTGGTTACGCTTTGCACAG GGGCTCGATGAGACAACAACCTACGAGGCGGCCGCA AAAAGGCCGGCGGCCACGAAAAAGGCCGGCCAGGCA AAAAAGAAAAAGGCTAGCGGCAGCGGCGCCGGATCC CCAAAGAAGAAAAGGAAGGTTGAAGACCCCAAGAAA AAGAGGAAGGTGTGATAA (SEQ ID NO: 30) |
| ABW4 | MGHHHHHHSSGLVPRGSG TMKNMESFINLYPVSKTL RFELKPIGKTLETFSRWI EELKEKEAIELKETGNLL AQDEHRAESYKKVKKILD EYHKWFITESLQNTKLNG LDVFYHNYMLPKKEDHEK KAFASCQDNLRKQIVNAF RQETGLENKLSGKELFKD SKEEVALLKAIVPYFDNK TLENIGVKSNEGALLLIE EFKDFTTYFGGFHENRKN MYSDEAKSTAVAFRLIHE NLPRFIDNKKVFEEKIMN SELKDKFPEILKELEQIL QVNEIEEMFQLDYFNDTL IQNGIDVYNHLIGGYAEE GKKKIQGLNEHINLYNQI QKEKNKRIPRLKPLYKQI LSDRETASFVIEAFENDG ELLESLEKSYRLLQQEVF TPEGKEGLANLLAAIAES ETHKIFLKNDLGLTEISQ QIYESWSLIEEAWNKQYD NKQKKVTETETYVDNRKK AFKSIKSFSIAEVEEWVK ALGNEKHKGKSVATYFKS LGKTDEKVSLIEQVENNY NIIKDLLNTPYPPSKDLA QQKDDVEKIKNYLDSLKA LQRFIKPLLGSGEESDKD AHFYGEFTAFWDVLDKVT | ATGGGCCACCATCATCATCATCATAGCAGCGGCCTG GTGCCGCGCGGCAGCGGTACCATGAAGAACATGGAG TCTTTTATTAATTTATATCCGGTTTCGAAAACTTTA CGTTTTGAGTTAAAGCCTATTGGCAAAACACTCGAA ACTTTCTCCCGCTGGATCGAAGAGTTGAAAGAGAAA GAGGCTATTGAGCTGAAAGAAACTGGCAACCTGTTG GCGCAGGATGAGCATCGGGCCGAGTCTTATAAGAAG GTCAAAAAAATTCTTGACGAATATCATAAATGGTTC ATCACTGAAAGCCTCCAGAACACAAAGTTAAATGGG TTGGACGTTTTTTATCATAACTATATGCTCCCGAAG AAAGAGGACCATGAGAAGAAAGCTTTTGCTTCGTGT CAAGATAATCTCCGTAAGCAAATTGTAAACGCGTTT CGTCAAGAAACCGGTTTATTTAACAAACTGTCAGGC AAAGAACTGTTTAAAGATTCGAAGGAAGAGGTTGCA CTGTTGAAAGCCATTGTACCGTATTTCGATAACAAG ACTCTGGAAAACATTGGTGTTAAGAGTAATGAAGGG GCTCTCCTTTTAATTGAAGAGTTCAAGGATTTTACC ACGTATTTCGGTGGCTTCCATGAGAATCGCAAAAAT ATGTATAGCGACGAAGCAAAATCAACAGCGGTTGCC TTTCGTCTTATTCACGAAATTTGCCGCGCTTCATT GACAATAAGAAGGTCTTCGAAGAGAAAATCATGAAT AGTGAATTAAAGGATAAATTTCCAGAGATTTTGAAG GAGCTGGAACAGATTCTGCAAGTCAACGAGATTGAA GAGATGTTTCAGCTCGACTATTTTAACGACACATTG ATCCAGAATGGCATCGATGTCTATAACCATTTGATC GGCGGCTACGCCGAGGAAGGCAAGAAAAAAATTCAA GGGCTTAACGAGCATATTAACCTCTATAACCAGATC CAGAAGGAGAAGAATAAGCGTATCCCGCGGCTGAAA CCACTCTATAAGCAAATTTTGAGTGATCGCGAAACC GCCTCATTTGTTATCGAGGCGTTTGAGAACGATGGC GAGTTATTAGAATCATTGGAGAAGTCATATCGCTTA CTGCAGCAGGAGGTCTTTACGCCTGAAGGTAAAGAA |

TABLE 26-continued

Sequences of exemplary engineered ABW nucleases

| Engineered Amino Acid Sequence | Engineered Nucleotide Sequence |
|---|---|
| PLYNKVRNYMTKKPYSTE KFKLNFENSYFLNGWAQD YETKAGLIFLKDGNYFLA INNKKLDEKEKKQLKTNY EKNPAKRIILDFQKPDNK NIPRLFIRSKGDNFAPAV EKYNLPISDVIDIYDEGK FKTEYRKINEPEYLKSLH KLIDYFKLGFSKHESYKH YSFSWKKTHEYENIAQFY HDVEVSCYQVLDENINWD SLMEYVEQNKLYLFQIYN KDFSPNSKGTPNMHTLYW KMLFNPDNLKDVVYKLNG QAEVFYRKASIKKENKIV HKANDPIDNKNELNKKKQ NTFEYDIVKDKRYTVDKF QFHVPITLNFKAEGLNNL NSKVNEYIKECDDLHIIG IDRGERHLLYLSLIDMKG NIVKQFSLNEIVNEHKGN TYRTNYHNLLDKREKERE KERESWKTIETIKELKEG YISQVVHKITQLMIEYNA IVVLEDLNFGFKRGRFKV EKQVYQKFEKMLIDKLNY LVDKKKEANESGGTLKAY QLTDSYADFMKYKKKQCG FLFYVPAWNTSKIDPTTG FVNLFDTHYVNVSKAQEF FSKFKSIRYNAANNYFEF EVTDYFSFSGKAEGTKQN WIICTHGTRIINFRNPEK NSQWDNKEVVITDEFKKL FEKHGIDYKNSSDLKGQI ASQSEKAFFHNEKKDTKD PDGLLQLFKLALQMRNSF IKSEEDYLVSPVMNDEGE FFDSRKAQPNQPENADAN GAYNIAMKGKWVVKQIRE SEDLDKLKLAISNKEWLN FAQRSAAAKRPAATKKAG QAKKKKASGSGAGSPKKK RKVEDPKKKRKV (SEQ ID NO: 42) | GGTCTGGCGAATTTACTCGCAGCAATCGCTGAAAGC GAGACACACAAGATCTTTCTGAAGAACGACTTGGGT CTCACCGAGATCTCTCAACAAATTTATGAATCATGG TCGCTGATTGAAGAGGCATGGAATAAACAATATGAC AACAAACAGAAGAAAGTTACGGAGACAGAGACATAT GTGGACAATCGGAAAAAGGCTTTCAAGTCCATCAAG AGCTTTAGCATCGCAGAGGTTGAGGAATGGGTGAAA GCACTTGGGAATGAGAAACACAAGGGCAAAAGCGTG GCAACCTATTTTAAAAGTCTCGGGAAGACTGACGAA AAAGTTAGCCTTATTGAACAGGTAGAGAACAATTAT AATATCATCAAGGACCTTTTGAACACACCGTATCCT CCTTCGAAGGACTTGGCCCAGCAAAAAGATGACGTT GAAAAAATCAAAATTATTTGGACTCTCTGAAGGCC CTCCAGCGGTTCATTAAGCCATTGTTGGGTAGCGGG GAGGAATCCGATAAAGATGCGCATCTTTTATGGTGAG TTTACCGCTTTCTGGGATGTGCTCGACAAAGTAACC CCACTCTACAATAAAGTCCGCAACTATATGACTAAG AAACCTTATAGCACAGAGAAATTTAAGCTGAATTTT GAAAATAGTTACTTTTTGAATGGTTGGGCACAGGAC TACGAGACAAAAGCGGGGCTTATCTTCTTGAAGGAC GGCAATTACTTCCTTGCCATCAATAATAAGAAATTA GATGAAAGGAGAAAAAACAGCTCAAGACTAATTAT GAGAAGAATCCTGCGAAGCGTATCATCTTAGACTTT CAGAAGCCAGACAATAAGAACATTCCTCGCTTGTTC ATTCGCAGTAAAGGCGACAATTTCGCTCCTGCAGTA GAAAAGTATAATCTTCCGATCTCTGACGTTATTGAC ATCTATGACGAGGGGAAGTTTAAGACTGAGTATCGC AAAATTAACGAGCCGGAATATCTCAAATCTCTCCAT AAGCTGATTGACTACTTCAAACTTGGGTTCTCCAAG CATGAATCCTACAAGCATTATTCTTTTTCATGGAAG AAAACACATGAGTATGAGAACATCGCCCAGTTTTAC CACGACGTGGAGGTCTCTTGCTACTACCAGGTCTGAC GAAAATATTAACTGGGATTCCCTCATGGAGTATGTA GAACAGAACAAATTGTACTTGTTCCAGATTTATAAC AAAGACTTCTCCCCAAACTGAAAGGCACTCCGAAT ATGCACACTTTGTACTGGAAGATGTTGTTTAATCCG GATAATCTTAAGGACGTGGTCTATAAGCTGAACGGT CAGGCTGAAGTATTCTACCGGAAGGCGAGTATTAAG AAAGAAAACAAGATTGTCCACAAGGCGAACGACCCT ATTGACAATAAAAACGAGTTGAATAAGAAAAAGCAA AATACATTTGAATACGACATCGTCAAAGATAAACGG TATACAGTGGATAAGTTTCAATTCCATGTTCCTATC ACGCTCAACTTTAAAGCTGAAGGCCTGAATAACTTG AATAGCAAAGTTAACGAATACATCAAAGAGTGTGAC GACCTTCACATTATTGGCATCGACCGGGGTGAACGG CACCTCTTGTATCTGAGCCTCATCGATATGAAAGGT AACATTGTAAAGCAATTTAGTCTTAACGAGATCGTT AATGAGCACAAGGGGAACACGTACCGCACGAACTAT CATAACCTCTTGGACAAACGTGAAAAGGAACGTGAA AAAGAGCGCGAGTCATGGAAAACCATTGAGACCATC AAAGAGCTGAAAGAAGGCTATATTAGTCAAGTAGTA CATAAAATCACTCAGTTAATGATCGAATATAATGCG ATCGTTGTACTCGAAGACCTGAATTTCGGCTTCAAA CGCGGCCGGTTCAAGGTGGAGAAGCAAGTGTATCAA AAATTTGAGAAGATGTTAATTGATAAACTGAACTAC TTGGTCGATAAGAAGAAGGAAGCCAATGAGAGTGGC GGGACACTCAAAGCCTACCAGCTTACCGATAGTTAC GCTGACTTCATGAAGTACAAGAAAAAGCAATGCGGC TTCCTGTTTTATGTCCCGGCCTGGAACACTTCCAAA ATCGATCCTACTACTGGGTTCGTGAATCTGTTTGAC ACACATTATGTCAATGTTAGTAAGGCCCAGGAATTT TTCTCGAAATTCAAGTCAATTCGCTACAACGCGGCC AACAACTATTTCGAGTTTGAAGTAACAGATTATTTT TCCTTCAGTGGTAAAGCTGAGGGCACCAAGCAGAAT TGGATCATTTGCACCCATGGCACCCGCATTATCAAT TTTCGTAACCCGGAAAAAAATTCGCAGTGGGATAAT AAGGAAGTAGTGATCACAGATGAATTCAAGAAACTG TTTGAGAAGCACGGCATTGACTACAAAAATAGTTCC GACCTCAAGGGGCAGATCGCCTCTCAATCGGAGAAG GCGTTTTTTCATAACGAAAAAAAAGATACAAAGGAC CCAGATGGCCTTCTGCAGCTTTTTAAACTGGCGCTG CAGATGCGGAACTCTTTCATTAAGAGCGAAGAGGAC TACTTAGTATCTCCTGTGATGAACGACGAAGGTGAA TTCTTTGACTCGCGCAAAGCCCAGCCTAATCAGCCA |

TABLE 26-continued

Sequences of exemplary engineered ABW nucleases

| Engineered Amino Acid Sequence | Engineered Nucleotide Sequence |
|---|---|
| | GAGAACGCTGATGCTAATGGGGCGTACAATATTGCA ATGAAAGGGAAATGGGTTGTTAAGCAAATCCGCGAA TCGGAGGACCTCGACAAGCTGAAACTGGCAATCTCA AATAAAGAATGGTTGAACTTCGCCCAGCGCTCCGCG GCCGCAAAAAGGCCGGCGGCCACGAAAAAGGCCGGC CAGGCAAAAAGAAAAAGGCTAGCGGCAGCGGCGCC GGATCCCCAAAGAAGAAAAGGAAGGTTGAAGACCCC AAGAAAAAGAGGAAGGTGTGATAA (SEQ ID NO: 43) |
| ABW5 MGHHHHHHSSGLVPRGSG TMKNILEQFVGLYPLSKT LRFELKPLGKTLEHIEKK GLIAQDEQRAEEYKLVKD IIDRYHKAFIHMCLKHFK LKMYSEQGYDSLEEYRKL ASISKRNEKEEQQFDKVK ENLRKQIVDAFKNGGSYD DLFKKELIQKHLPRFIEG EEEKRIVDNFNKFTTYFT GFHENRKNMYSDEKESTA IAYRLIHENLPLFLDNMK SFAKIAESEVAARFTEIE TAYRTYLNVEHISELFTL DYFSTVLTQEQIEVYNNI IGGRVDDDNVKIQGLNEY VNLYNQQQKDRSKRLPLL KSLYKMILSDRIAISWLP EEFKSDKEMIEAINNMHD DLKDILAGDNEDSLKSLL QHIGQYDLSKIYIANNPG LTDISQQMFGCYDVFTNG IKQELRNSITPSKKEKAD NEIYEERINKMFKSEKSF SIAYLNSLPHPKTDAPQK NVEDYFALLGTCNQNDEQ PINLFAQIEMARLVASDI LAGRHVNLNQSENDIKLI KDLLDAYKALQHFVKPLL GSGDEAEKDNEFDARLRA AWNALDIVTPLYNKVRNW LTRKPYSTEKIKLNFENA QLLGGWDQNKEPDCTSVL LRKDGMYYLAIMDKKANH AFDCDCLPSDGACFEKID YKLLPGANKMLPKVFFSK SRIKEFSPSESIIAAYKK GTHKKGPNFSLSDCHRLI DFFKASIDKHEDWSKFRF RFSDTKTYEDISGFYREV EQQGYMLGFRKVSEAFVN KLVDEGKLYLFHIWNKDF SKHSKGTPNLHTIYWKML FDEKNLTDVIYKLNGQAE VFYRKKSLDLNKTTTHKA HAPITNKNTQNAKKGSVF DYDIIKNRRYTVDKFQPH VPITLNFKATGRNYINEH TQEAIRNNGIEHIIGIDR GERHLLYLSLIDLKGNIV KQMTLNDIVNEYNGRTYA TNYKDLLATREGERTDAR RNWQKIENIKEIKEGYLS QVVHILSKMMVDYKAIVV LEDLNTGFMRNRQKIERQ VYEKFEKMLIDKLNCYVD KQKDADETGGALHPLQLT NKFESFRKLGKQSGWLFY IPAWNTSKIDPVTGFVNM LDTRYENADKARCFFSKF DSIRYNADKDWFEFAMDY SKFTDKAKDTYTWWTLCS YGTRIKTFRNPAKNNLWD NEEVVLTDEFKKVFAAAG | ATGGGCCACCATCATCATCATCATAGCAGCGGCCTG GTGCCGCGCGGCAGCGGTACCATGAAGAACATCTTA GAGCAGTTTGTCGGCTTATATCCGTTGTCTAAAACA CTTCGGTTTGAGCTTAAACCTTTGGGTAAGACGTTG GAACATATTGAGAAAAAGGCTTGATTGCCCAAGAC GAACAGCGGGCGGAGGAGTACAAATTGGTTAAAGAT ATTATTGATCGCTACCACAAGGCTTTTATTCATATG TGCTTAAAACATTTTAAGCTCAAGATGTACAGTGAA CAAGGGTATGATAGCTTGGAGGAGTACCGCAAGCTT GCGTCAATTTCCAAACGCAACGAGAAAGAGGAGCAG CAATTTGACAAAGTCAAGGAAAATCTTCGTAAGCAA ATTGTCGACGCGTTTAAAAATGGCGGGAGTTATGAT GATCGTTTAAGAAAGAATTGATCCAGAAACACCTC CCACGTTTTATTGAGGGTGAAGAAGAAAAACGTATC GTTGACAACTTCAACAAGTTCACGACCTATTTTACT GGTTTTCATGAAAATCGCAAGAATATGTATAGTGAC GAAAAGGAATCGACGGCTATTGCTTATCGTCTCATT CACGAAAACTTGCCATTGTTTTTGGATAACATGAAG AGCTTCGCTAAGATCGCCGAATCGGAAGTGGCTGCT CGTTTTACCGAAATCGAAACCGCTTACCGGACATAC TTGAACGTAGAACACATTAGTGAACTGTTCACCCTC GACTATTTTAGCACGGTTTTGACGCAAGAACAAATC GAAGTATATAATAACATTATCGGCGGGCGCGTCGAC GACGACAACGTAAAGATCCAAGGGTTGAATGAGTAC GTAAATTTATATAATCAGCAGCAGAAGGACCGGTCT AAGCGCTTACCGCTTCTTAAGTCCCTCTACAAAATG ATCTTATCCGATCGTATTGCAATTTCGTGGTTACCT GAGGAGTTCAAATCCGATAAGGAGATGATTGAAGCA ATTAACAACATGCATGACGACCTGAAGGACATTCTG GCAGGCGACAACGAAGACTCGCTTAAGTCCTTACTG CAGCATATTGGCCAATACGATCTCTCGAAAATCTAC ATTGCGAACAATCCGGGCCTGACAGATATCTCACAA CAAATGTTCGGGTGTTATGACGTCTTTACTAATGGG ATCAAGCAGGAGCTCCGGAACAGTATTACCCCTTCA AAAAAGGAGAAAGCCGATAACGAAATCTACGAGGAG CGGATTAACAAAATGTTTAAAAGTGAGAAGAGTTTC TCAATTGCCTACCTGAATTCGTTGCCGCACCCAAAG ACGGATGCGCCTCAAAAAAATGTTGAGGATTATTTT GCTCTCCTGGGGACTTGCAATCAAAACGATGAACAG CCGATTAATTTGTTTGCCCAAATTGAGATGGCACGC TTAGTCGCCTCTGATATTCTCGCAGGCCGGCACGTT AATTTGAACCAATCTGAGAATGATATCAAGTTAATC AAGGATCTGTTAGATGCTTACAAGGCTCTGCAGCAT TTCGTCAAACCACTCCTTGGCTCGGGTGACGAGGCT GAGAAAGATAACGAGTTCGATGCACGCCTCCGTGCG GCTTGGAATGCGTTGGACATTGTTACACCACTCTAT AACAAGGTTCGGAACTGGCTGACCCGCAAACCATAT TCTACAGAAAAATCAAGCTTAATTTCGAAAACGCC CAACTTCTGGGGGGTTGGGATCAGAACAAAGAACCG GATTGCACATCAGTCCTCCTTCGGAAGGATGGGATG TACTATTTAGCGATCATGGATAAAAAGGCAAATCAC GCCTTTGACTGTGACTGCTTACCGTCTGACGGGGCC TGTTTCGAGAAAATTGACTACAAGCTGCCCGGGC GCGAATAAATGTTGCCGAAAGTTTTTTTTCTAAA AGCCGCATCAAAGAATTTTCCCCTTCGAGTCGATC ATCGCTGCTTATAAAAAGGGGACTCATAAAAAGGG CCGAATTTCAGTCTCTCTGATTGTCATCGCTTGATT GACTTTTTTAAGGCTAGCATTGATAAGCACGAAGAT TGGTCAAAATTTCGTTTTCGCTTCTCAGATACCAAA ACGTATGAAGACATCAGTGGTTTCTACCGTGAAGTA GAACAGCAAGGCTATATGCTGGGTTTTCGTAAAGTC TCTGAGGCCTTTGTGAATAAACTCGTTGATGAAGGT AAGTTATACTTATTCCATATCTGGAACAAAGACTTT AGTAAGCACTCCAAAGGTACACCTAATCTCCACACT |

TABLE 26-continued

Sequences of exemplary engineered ABW nucleases

| Engineered Amino Acid Sequence | Engineered Nucleotide Sequence |
|---|---|
| IDVHENLKEAICALTDKK YLEPLMRLMTLLVQMRNS ATNSETDYLLSPVADESG MFYDSREGKETLPKDADA NGAYNIARKGLWTIRRIQ ATNCEEKVNLVLSNREWL QFAQQKPYLNDAAAKRPA ATKKAGQAKKKKASGSGA GSPKKKRKVEDPKKKRKV (SEQ ID NO: 55) | ATTTATTGGAAAATGCTCTTCGATGAGAAAAATCTC ACTGACGTCATCTACAAACTGAATGGGCAGGCTGAA GTATTCTACCGTAAAAAAAGTCTGGATCTTAATAAG ACAACTACTCACAAGGCACATGCCCCAATCACCAAT AAAAATACCCAAAACGCAAAGAAGGGTAGTGTTTTC GATTACGATATCATCAAAAATCGTCGCTACACAGTG GACAAATTCCAGTTCCACGTCCCTATCACCTTAAAT TTTAAGGCAACAGGTCGTAATTACATTAATGAGCAC ACTCAAGAGGCAATCCGTAATAATGGCATCGAACAT ATCATTGGCATCGACCGTGGGGAGCGTCACTTGCTT TACTTGTCGCTCATTGATCTGAAGGGTAATATCGTC AAGCAGATGACCCTTAATGATATTGTCAATGAATAT AATGGTCGGACTTATGCGACGAACTACAAGGACTTG CTGGCAACACGGGAGGGTGAGCGTACGGACGCTCGG CGCAACTGGCAGAAGATTGAAAATATTAAAGAAATC AAGGAAGGTTACCTTAGCCAGGTGGTGCACATCTTG AGTAAAATGATGGTCGACTACAAGGCTATCGTTGTT CTGGAAGACTTGAATACAGGCTTCATGCGGAATCGT CAAAAAATCGAACGTCAAGTATATGAGAAGTTCGAA AAAATGTTAATTGACAAGCTGAACTGCTATGTTGAC AAACAAAAGGATGCTGACGAGACGGGCGGTGCCCTC CACCCGCTGCAGCTGACAAACAAATTTGAGTCGTTT CGTAAGTTAGGTAAGCAGAGTGGTTGGCTTTTTTAC ATCCCAGCATGGAACACTTCGAAAATCGACCCAGTT ACTGGGTTCGTGAACATGTTAGACACGCGCTACGAG AACGCCGATAAGGCGCGGTGTTTCTTCTCGAAATTC GATTCCATCCGGTATAACGCTGACAAAGATTGGTTT GAGTTTGCTATGGATTACAGTAAGTTCACTGATAAA GCGAAAGATACTTACACGTGGTGGACTCTGTGTTCC TATGGGACGCGTATTAAAACTTTTCGTAATCCGGCT AAGAATAATTTGTGGGATAATGAGGAGGTTGTCCTT ACTGATGAGTTCAAGAAAGTTTTCGCAGCGGCAGGT ATTGATGTCCATGAGAACCTTAAGGAAGCGATCTGT GCTCTGACAGATAAAAAGTATCTTGAACCACTCATG CGTCTCATGACCCTGCTCGTTCAAATGCGGAACTCT GCTACTAACTCCGAAACAGACTATTTACTTTCACCA GTTGCTGACGAGTCAGGGATGTTCTATGACTCCCGC GAAGGGAAGGAAACACTGCCAAAAGATGCGGACGCC AACGGTGCATATAACATTGCCCGTAAGGGCCTCTGG ACCATCCGGCGGATTCAAGCCACCAACTGTGAGGAG AAAGTTAACTTAGTCCTCAGTAATCGTGAATGGTTG CAGTTTGCCCAGCAGAAACCATATCTGAATGATGCG GCCGCAAAAAGGCCGGCGGCCACGAAAAAGGCCGGC CAGGCAAAAAAGAAAAAGGCTAGCGGCAGCGGCGCC GGATCCCCAAAGAAGAAAAGGAAGGTTGAAGACCCC AAGAAAAAGAGGAAGGTGTGATAA (SEQ ID NO: 56) |
| ABW 6 MGHHHHHHSSGLVPRGSG TMIYRENFKRKKEKIEMN TGFNDFTNLSSVTKTLCN RLIPTEITAKYIKEHGVI EADQERNMMSQELKNILN DFYRSFLNENLVKVHELD FKPLFTEMKKYLETKDNK EALEKAQDDMRKAIHDIF ESDDRYKKMFKAEITASI LPEFILHNGAYSAEEKEE KMQVVKMFNGFMTSFSAF FTNRENCESKEKISSSAC YRIVDDNAKIHFDNIRIY KNIANKFDYEIEMIEKIE EAAGGADIRNIFSYNFDH FAFNHFVSQDDISFYNYV VGGINKFMNLYCQATKEK LSPYKLRHLHKQILCIEE SLYDVPAKFNCDEDVYAA VNDFLNNVRTKSVIERLQ MLGKNADSYDLDKIYISK KHFTNISQTLYRDESVIN TALTMSYIDTLPGKGKTK EKKAASMAKNTELISLGE IDKLVDKYNLCPDKAAST RSLIRSISDIVADYKANP | ATGGGCCACCATCATCATCATCATAGCAGCGGCCTG GTGCCGCGCGGCAGCGGTACCATGATCTACCGTGAG AATTTTAAGCGGAAAAAGGAGAAGATTGAAATGAAC ACTGGGTTTAATGACTTCACTAACTTGAGTTCCGTG ACCAAGACGTTATGCAACCGGTTGATCCCAACAGAA ATTACCGCAAAGTACATTAAGGAGCATGGGGTAATT GAGGCGGACCAAGAACGGAACATGATGAGTCAAGAG CTGAAAAATATCTTGAATGACTTTTACCGGAGTTTC CTGAACGAGAACCTTGTGAAGGTGCACGAACTTGAT TTCAAGCCGTTATTCACCGAGATGAAAAAGTACCTC GAAACAAAGATAACAAGGAAGCACTCGAAAAGGCC CAGGACGACATGCGGAAGGCAATCCATGATATCTTT GAAAGTGATGACCGCTACAAAAAAATGTTCAAGGCT GAGATCACGGCGTCGATTTTGCCTGAATTCATTCTT CATAACGGGGCATATTCAGCCGAAGAAAGGAGGAG AAAATGCAAGTAGTCAAGATGTTCAATGGCTTTATG ACGTCTTTCTCAGCATTCTTTACGAATCGTGAGAAT TGTTTCTCCAAAGAAAAGATCAGCTCCTCCGCATGT TACCGTATTGTTGATGACAACGCGAAAATCCATTTC GATAACATTCGTATTTATAAAAATATCGCCAACAAG TTCGATTATGAAATTGAAATGATCGAGAAGATCGAA GAGGCGGCGGGGGGTGCCGACATTCGTAATATCTTC TCGTACAACTTTGACCACTTTGCATTCAATCATTTC GTTAGTCAAGATGATATCTCATTCTACAATTATGTT GGTGGTATTAACAAGTTTATGAACTTGTATTGT CAAGCCACCAAAGAGAAATTATCGCCTTATAAACTG |

TABLE 26-continued

Sequences of exemplary engineered ABW nucleases

| Engineered Amino Acid Sequence | Engineered Nucleotide Sequence |
|---|---|
| LTMNSGIPLAENETEIAV LKEAIEPFMDIFRWCAKF KTDEPVDKDTDFYTELED INDEIHSIVSLYNRTRNY VTKKPYNTDKFGLYFGTS SFASGWSESKEFTNNAIL LAKDDKFYLGVFNAKNKP AKSIIKGHDTIQDGDYKK MVYSLLTGPNKMLPHMFI SSSKAVPVYGLTDELLSD YKKGRHLKTSKNFDIDYC HKLIDYFKHCLALYTDWD CFNFKFSDTESYNDIGEF YKEVAEQGYYMNWTYIGS DDIDSLQENGQLYLFQIY NKDFSEKSFGKPSKHTAI LRSLFSDENVADPVIKLC GGTEVFFRPKSIKTPVVH KKGSILVSKTYNAQEMDE NGNIITVRKCVPDDVYME LYGYYNNSGTPLSAEALK YKDIVDHRTAPYDIIKDR RYTEDEFFINMPVSLNYK AENRRVNVNEMALKYIAQ TKDTYIIGIDRGERNLLY VSVIDTDGNIVEQKSLNI INNVDYQA TABLE 26-continued Sequences of exemplary engineered ABW nucleases

| Engineered Amino Acid Sequence | Engineered Nucleotide Sequence |
|---|---|
| | ACGGTACAGATGCGTAACAGCCTTTGCGAGAGTAAA
GATCGCGAGTACGACAAGTTCGTCTCACCTATTCTC
AACGCGTCGGGCAAATTTTTCGACACCGATGCCGCT
GATAAAAGTCTGCCTATTGAAGCTGATGCGAACGAT
GCGTATGGTATTGCTATGAAAGGGTTGTATAATGTT
TTACAAGTCAAAAACAACTGGGCGGAGGGCGAGAAA
TTTAAGTTCTCCCGTTTAAGCAACGAAGATTGGTTC
AACTTCATGCAAAAGCGGGCGGCCGCAAAAAGGCCG
GCGGCCACGAAAAAGGCCGGCCAGGCAAAAAAGAAA
AAGGCTAGCGGCAGCGGCGCCGGATCCCCAAAGAAG
AAAAGGAAGGTTGAAGACCCCAAGAAAAAGAGGAAG
GTGTGATAA (SEQ ID NO: 69) |
| ABW 7 MGHHHHHHSSGLVPRGSL
QMTMDYGNGQFERRAPLT
KTITLRLKPIGETRETIR
EQKLLEQDAAFRKLVETV
TPIVDDCIRKIADNALCH
FGTEYDFSCLGNAISKND
SKAIKKETEKVEKLLAKV
LTENLPDGLRKVNDINSA
AFIQDTLTSFVQDDADKR
VLIQELKGKTVLMQRFLT
TRITALTVWLPDRVFENF
NIFIENAEKMRILLDSPL
NEKIMKFDPDAEQYASLE
FYGQCLSQKDIDSYNLII
SGIYADDEVKNPGINEIV
KEYNQQIRGDKDESPLPK
LKKLHKQILMPVEKAFFV
RVLSNDSDARSILEKILK
DTEMLPSKITEAMKEADA
GDIAVYGSRLHELSHVIY
GDHGKLSQIIYDKESKRI
SELMETLSPKERKESKKR
LEGLEEHIRKSTYTFDEL
NRYAEKNVMAAYIAAVEE
SCAEIMRKEKDLRTLLSK
EDVKIRGNRHNTLIVKNY
FNAWTVFRNLIRILRRKS
EAEIDSDFYDVLDDSVEV
LSLTYKGENLCRSYITKK
IGSDLKPEIATYGSALRP
NSRWWSPGEKFNVKFHTI
VRRDGRLYYFILPKGAKP
VELEDMDGDIECLQMRKI
PNPTIFLPKLVFKDPEAF
FRDNPEADEFVFLSGMKA
PVTITRETYEAYRYKLYT
VGKLRDGEVSEEEYKRAL
LQVLTAYKEFLENRMIYA
DLNFGFKDLEEYKDSSEF
IKQVETHNTFMCWAKVSS
SQLDDLVKSGNGLLFEIW
SERLESYYKYGNEKVLRG
YEGVLLSILKDENLVSMR
TLLNSRPMLVYRPKESSK
PMVVHRDGSRVVDRFDKD
GKYIPPEVHDELYRFFNN
LLIKEKLGEKARKILDNK
KVKVKVLESERVKWSKFY
DEQFAVTFSVKKNADCLD
TTKDLNAEVMEQYSESNR
LILIRNTTDILYYLVLDK
NGKVLKQRSLNIINDGAT
DVDWKERFRQVTKDRNEG
YNEWDYSRTSNDLKEVYL
NYALKEIAEAVIEYNAIL
IIEKMSNAFKDKYSFLDD
VTFKGFETKLLAKLSDLH
FRGIKDGEPCSFTNPLQL
CQNDSNKILQDGVIFMVP
NSMTRSLDPDTGFIFAIN
DHNIRTKKAKLNFLSKFD | ATGGGCCACCATCATCATCATCATAGCAGCGGCCTG
GTGCCGCGCGGCAGCCTGCAGATGACAATGGATTAC
GGTAACGGTCAATTTGAGCGGCGCGCCCCGCTCACC
AAGACAATCACTCTCCGGTTGAAACCGATCGGGGAG
ACCCGTGAGACGATTCGCGAGCAAAAGCTCCTCGAA
CAAGATGCTGCATTCCGTAAACTTGTTGAAACTGTC
ACCCCTATCGTGGATGATTGTATCCGGAAAATTGCT
GACAACGCTTTGTGTCATTTTGGCACGGAATATGAT
TTCTCCTGTTTAGGTAATGCCATCTCAAAAAATGAC
AGCAAAGCGATTAAGAAAGAGACCGAAAAGTAGAG
AAGCTGTTGGCCAAGGTTCTGACAGAGAACTTGCCA
GACGGTCTGCGTAAAGTCAACGATATTAACAGCGCG
GCTTTTATTCAGGACACACTGACATCATTCGTCCAG
GACGATGCTGACAAACGTGTGTTAATTCAAGAGTTA
AAGGGCAAAACTGTGTTAATGCAACGCTTTTTAACA
ACCCGGATTACTGCATTGACTGTATGGCTCCCTGAC
CGGGTGTTTGAGAACTTCAACATTTTTATCGAAAAT
GCTGAAAAGATGCGCATCTTGCTCGACTCACCATTG
AATGAAAAGATCATGAAGTTCGATCCGGATGCTGAA
CAATACGCGAGTTTGGAATTCTATGGTCAATGCTCTG
TCCCAGAAGGATATTGATTCGTACAACCTCATCATT
TCCGGGATTTATGCCGATGATGAGGTCAAGAACCCA
GGTATCAATGAAATTGTTAAGGAATACAACCAGCAA
ATTCGCGGGGATAAGGATGAGTCACCTTTACCTAAA
CTGAAAAAGTTGCATAAACAAATTTTGATGCCTGTC
GAGAAGGCATTTTCGTTCGGGTACTCAGTAATGAT
TCTGATGCTCGTTCAATTTTAGAAAAAATCTTGAAG
GATACTGAGATGTTGCCTTCTAAGATCATTGAAGCG
ATGAAGAAGCAGACGCTGGGGACATCGCTGTATAT
GGTTCACGTTTGCACGAGTTAAGCCACGTAATCTAT
GGCGATCACGGGAAGCTCTCTCAGATTATCTATGAT
AAGGAGTCGAAACGCATCAGCGAGCTCATGGAAACG
TTATCGCCTAAGGAGCGCAAAGAGTCAAAGAAACGC
TTGGAGGGTCTGGAAGAACATATCCGGAAGTCGACA
TATACCTTCGACGAGCTTAATCGTTATGCGGAAAAG
AACGTCATGGCTGCCTACATCGCGGCCGTGGAGGAA
AGCTGCGCCGAAATTATGCGTAAGGAGAAGGACTTA
CGCACGCTTCTTAGTAAGGAGGATGTCAAGATTCGT
GGTAATCGCCACAATACGTTAATTGTTAAGAACTAC
TTCAATGCCTGGACTGTCTTCCGGAATTTGATCCGC
ATCCTCCGGCGGAAATCCGAGGCGGAGATCGACTCA
GATTTCTATGACGTCTTGGATGACTCTGTGGAAGTT
TTATCGCTCACATATAAAGGTGAAAACTTGTGCCGG
TCTTACATTACGAAGAAGATCGGGAGCGATTTAAAG
CCAGAGATTGCTACCTATGGTTCCGCCTTGCGCCCT
AATTCACGGTGGTGGTCACCGGGCGAGAAGTTTAAC
GTAAAGTTCCACACCATTGTTCGCCGGGACGGTCGC
CTTTATTATTTCATCTTGCCGAAAGGTGCCAAACCT
GTCGAGCTCGAAGATATGGATGGGGACATCGAATGC
TTGCAAATGCGCAAGATTCCGAATCCGACTATTTTC
CTTCCAAAATTGGTTTTCAAGGACCCAGAGGCCTTC
TTCCGCGACAATCCAGAGGCAGATGAATTCGTTTTT
CTTTCGGGTATGAAAGCTCCAGTGACCATCACGCGT
GAAACCTATGAGGCGTATCGCTACAAACTTTATACA
GTTGGGAAGTTACGCGACGGTGAAGTGAGCGAAGAA
GAGTATAAACGTGCGTTGTTACAAGTATTGACCGCG
TATAAGGAATTCTTAGAGAATCGGATGATCTACGCA
GATCTGAACTTTGGCTTTAAAGATCTCGAAGAATAC
AAAGACTCGTCAGAATTTATCAAACAAGTCGAAACT
CACAACACTTTTATGTGCTGGGCTAAGGTCAGTAGC
AGTCAGCTCGACGACCTGGTCAAGAGCGGGAACGGG |

TABLE 26-continued

Sequences of exemplary engineered ABW nucleases

| Engineered Amino Acid Sequence | Engineered Nucleotide Sequence |
|---|---|
| QLKVSSEGCLIMKYSGDS LPTHNTDNRVWNCCCNHP ITNYDRETKKVEFIEEPV EELSRVLEENGIETDTEL NKLNERENVPGKVVDAIY SLVLNYLRGTVSGVAGQR AVYYSPVTGKKYDISFIQ AMNLNRKCDYYRIGSKER GEWTDFVAQLINAAAKRP AATKKAGQAKKKKASGSG AGSPKKKRKVEDPKKKRK V (SEQ ID NO: 81) | TTACTGTTCGAAATCTGGTCAGAACGGTTGGAGTCC TATTACAAATATGGCAACGAGAAGGTGCTGCGTGGG TACGAGGGCGTTCTTTTGAGTATCCTTAAGGACGAG AACCTCGTGAGCATGCGGACGCTGCTTAATTCTCGG CCGATGCTCGTCTACCGCCCTAAAGAATCATCCAAG CCGATGGTCGTTCACCGGGACGGTAGCCGCGTCGTT GATCGGTTCGATAAGGATGGGAAGTATATTCCACCA GAGGTACACGACGAATTATACCGGTTCTTTAACAAT TTGCTTATTAAGGAAAAGCTCGGCGAGAAAGCGCGC AAAATTTTAGACAACAAAAAAGTAAAAGTAAAGGTA TTGGAATCTGAACGTGTAAAGTGGTCAAAGTTTTAT GATGAACAGTTTGCAGTTACATTCTCTGTTAAAAAG AATGCAGACTGTCTGGATACCACGAAAGATCTCAAT GCCGAAGTTATGGAGCAGTATTCCGAATCGAACCGG CTTATCCTGATCCGCAATACCACTGACATCTTGTAT TATCTTGTACTTGATAAGATGGGAAAGTGCTGAAA CAACGCTCATTGAATATCATTAACGACGGGGCTCGC GACGTTGATTGGAAAGAGCGTTTTCGGCAGGTAACA AAAGATCGTAACGAAGGCTATAACGAGTGGGACTAC TCGCGGACTAGCAACGATTTGAAAGAGGTCTATCTG AATTATGCATTGAAGGAGATTGCCGAAGCGGTAATC GAATACAACGCAATTTTGATTATTGAAAAAATGTCG AATGCCTTCAAGGATAAGTACTCCTTTTTGGATGAT GTTACCTTCAAAGGTTTTGAGACCAAACTTCTTGCG AAGCTCTCTGACTTGCATTTCCGGGGTATTAAAGAT GGGGAGCCATGTTCGTTTACGAACCCGTTACAGTTA TGTCAGAACGACTCAAACAAAATTTTACAAGACGGT GTGATTTTCATGGTCCCTAACAGCATGACGCGCAGT CTGGACCCTGACACTGGGTTCATTTTTGCGATTAAC GATCACAACATCCGCACTAAGAAAGCGAAGTTAAAC TTCCTTAGTAAATTCGATCAGCTGAAAGTGTCATCA GAGGGCTGTTTAATCATGAAATATTCGGGGGACTCC CTTCCTACACACAACACAGATAATCGTGTATGGAAC TGTTGTTGCAATCACCCGATCACCAACTACGACCGC GAGACGAAAAAGGTCGAATTCATCGAGGAGCCAGTG GAAGAGTTGAGTCGCGTCTTAGAAGAGAATGGGATT GAGACAGATACGGAACTTAACAAGCTTAACGAGCGC GAGAATGTTCCGGGCAAGGTAGTAGATGCCATCTAT TCTCTGGTGTTGAATTACTTGCGTGGTACCGTGTCC GGCGTTGCAGGCCAACGGGCGGTCTACTATTCCCCT GTGACGGGGAAAAAATATGATATTTCGTTTATCCAA GCAATGAATCTGAATCGTAAGTGCGATTACTACCGG ATCGGGAGCAAAGAACGCGGCGAATGGACGGATTTT GTAGCGCAGTTAATTAACGCGGCCGCAAAAAGGCCG GCGGCCACGAAAAAGGCCGGCCAGGCAAAAAAGAAA AAGGCTAGCGGCAGCGGCGCCGGATCCCCAAAGAAG AAAGGAAGGTTGAAGACCCCAAGAAAAAGAGGAAG GTGTGATAA (SEQ ID NO: 82) |
| ABW8 | MGHHHHHHSSGLVPRGSG TMCYDLNNIKTKLREREV ETMGNNMDNSFEPPIGGN SVSKTLRNELRVGSEYTG KHIKECAIIAEDAVKAEN QYIVKEMMDDFYRDFINR KLDALQGINWEQLFDIMK KAKLDKSNKVSKELDKIQ ESTRKEIGKIFSSDPIYK DMLKADMISKILPEYIVD KYGDAASRIEAVKVFYGF SGYFIDFWASRKNVFSDK NIASAIPHRIVNVNARIH LDNITAFNRIAEIAGDEV AGIAEDACAYLQNMSLED VFTGACYGEFICQKDIDR YNNICGVINQHMNQYCQN KKISRSKFKMERLHKQIL CRSESGFEIPIGFQTDGE VIDAINSFSTILEEKDIL DRLRTLSQEVTGYDMERI YVSSKAFESVSKYIDHKW DVIASSMYNYFSGAVRGK DDKKDVKIQTEIKKIKSC SLLDLKKLVDMYYKMDGM | ATGGGCCACCATCATCATCATCATAGCAGCGGCCTG GTGCCGCGCGGCAGCGGTACCATGTGCTACGACTTA AACAACATCAAGACAAAGTTACGTGAACGCGAAGTC GAAACTATGGGCAATAACATGGATAATAGCTTCGAG CCTTTTATTGGCGGTAATAGTGTCTCTAAAACACTT CGGAATGAGCTGCGTGTAGGTTCCGAATATACTGGT AAACACATTAAAGAGTGCGCGATCATTGCAGAGGAC GCCGTGAAGGCGGAGAACCAGTACATCGTAAAGAA ATGATGGACGACTTTTACCGTGACTTCATTAATCGC AAACTTGACGCCTTGCAGGGTATTAATTGGGAGCAG CTTTTTGACATTATGAAGAAGGCGAAATTGGATAAG TCGAATAAAGTCAGCAAAGAGTTAGACAAGATTCAA GAGTCTACGCGGAAAGAAATCGGGAAAATCTTCTCA TCCGATCCAATCTATAAAGACATGCTCAAAGCGGAC ATGATCAGCAAAATTCTGCCAGAGTATATTGTCGAC AAATACGGTGATGCAGCCTCGCGGATCGAAGCTGTA AAGGTGTTTTACGGCTTTTCGGGTTATTTTATCGAC TTCTGGGCATCGCGCAAGAACGTCTTCTCAGATAAG AACATCGCGTCGGCCATTCCGCACCGGATTGTCAAT GTGAACGCTCGGATCCATCTGGACAACATCACGGCC TTCAACCGTATCGCAGAAATTGCAGGGGATGAAGTC GCCGGCATTGCTGAAGATGCTTGTGCTTACCTGCAG AATATGAGCTTAGAGGATGTATTCACGGGGGCCTGC TACGGTGAGTTCATCTGTCAGAAGGATATTGATCGT TACAATAACATTTGCGGTGTTATCAACCAGCACATG |

TABLE 26-continued

Sequences of exemplary engineered ABW nucleases

| Engineered Amino Acid Sequence | Engineered Nucleotide Sequence |
|---|---|
| CLEHEATEYVAGITEILV<br>DFNYKTFDMDDSVKMIQN<br>EHMINEIKEYLDTYMSIY<br>HWAKDFMIDELVDRDMEF<br>YSELDEIYYDLSDIVPLY<br>NKVRNYVTQKPYSQDKIK<br>LNFGSPTLANGWSKSKEF<br>DNNVVVLLRDEKIYLAIL<br>NVGNKPSKDIMAGEDRRR<br>SDTDYKKMNYYLLPGASK<br>TLPHVFISSNAWKKSHGI<br>PDEIMYGYNQNKHLKSSP<br>NFDLEFCRKLIDYYKECI<br>DSYPNYQIFNFKFAATET<br>YNDISEFYKDVERQGYKI<br>EWSYISEDDINQMDRDGQ<br>IYLFQIYNKDFAPNSKGM<br>QNLHTLYLKNIFSEENLS<br>DVVIKLNGEAELFFRKSS<br>IQHKRGHKKGSVLVNKTY<br>KTTEKTENGQGEIEVIES<br>VPDQCYLELVKYWSEGGV<br>GQLSEEASKYKDKVSHYA<br>ATMDIVKDRRYTEDKFFI<br>HMPITINFKADNRNNVNE<br>KVLKFIAENDDLHVIGID<br>RGERNLLYVSVIDSRGRI<br>VEQKSFNIVENYESSKNV<br>IRRHDYRGKLVNKEHYRN<br>EARKSWKEIGKIKEIKEG<br>YLSQVIHEISKLVLKYNA<br>IIVMEDLNYGFKRGRFKV<br>ERQVYQKFETMLINKLAY<br>LVDKSRAVDEPGGLLKGY<br>QLTYVPDNLGELGSQCGI<br>IFYVPAAYTSKIDPVTGF<br>VDVFDFKAYSNAEARLDF<br>INKLDCIRYDAPRNKFEI<br>AFDYGNFRTHHTTLAKTS<br>WTIFIHGDRIKKERGSYG<br>WKDEIIDIEARIRKLFED<br>TDIEYADGHNLIGDINEL<br>ESPIQKKFVGELFDIIRF<br>TVQLRNSKSEKYDGTEKE<br>YDKIISPVMDEEGVFFTT<br>DSYIRADGTELPKDADAN<br>GAYCIALKGLYDVLAVKK<br>YWKEGEKFDRKLLAITNY<br>NWFDFIQNRRFAAAKRPA<br>ATKKAGQAKKKKASGSGA<br>GSPKKKRKVEDPKKKRKV<br>(SEQ ID NO: 94) | AATCAATACTGCCAAAACAAAAAGATCTCACGCTCA<br>AAATTTAAGATGGAACGTCTGCACAAACAGATCTTA<br>TGTCGCTCTGAGAGTGGTTTTGAGATCCCGATTGGG<br>TTTCAAACCGACGGGGAGGTAATCGATGCTATCAAC<br>TCCTTTTCTACGATTCTTGAAGAGAAAGATATCTTG<br>GATCGTCTGCGCACTTTGTCGCAGGAGGTAACAGGT<br>TATGACATGGAGCGTATCTATGTAAGTTCCAAGGCG<br>TTTGAGTCTGTATCAAAGTACATCGATCACAAATGG<br>GACGTAATTGCTTCTTCCATGTACAATTACTTTTCT<br>GGGGCTGTTCGTGGGAAGGACGACAAGAAAGATGTC<br>AAGATTCAGACGGAAATTAAAAAGATTAAGTCATGT<br>TCGTTATTGGACCTCAAAAAGCTGGTAGATATGTAT<br>TATAAAATGGATGGGATGTGTTTAGAGCACGAAGCG<br>ACGGAGTACGTGGCAGGTATTACGGAGATCCTGGTT<br>GACTTTAACTATAAGACCTTCGACATGGATGATTCC<br>GTTAAGATGATTCAAAATGAGCACATGATTAATGAA<br>ATTAAAGAATATTTAGATACCTATATGTCTATCTAT<br>CATTGGGCGAAGGACTTTATGATCGATGAGCTCGTA<br>GATCGCGACATGGAATTCTACAGTGAGCTCGATGAA<br>ATCTATTATGATTTGTCCGACATCGTACCACTGTAT<br>AATAAAGTCCGCAACTACGTCACGCAAAACCGTAT<br>TCCCAGGATAAAATCAAGTTAAACTTTGGCAGCCCA<br>ACCTTAGCAAACGGTTGGAGCAAGTCGAAAGAATTT<br>GATAACAACGTTGTAGTATTGTTGCGTGACGAAAAG<br>ATTTATCTGGCCATCTTAAATGTGGGGAATAAACCG<br>TCAAAGGATATCATGGCGGGCGAAGACCGTCGTCGC<br>TCCGATACTGATTACAAGAAAATGAATTACTATCTG<br>CTCCCTGGGGCAAGCAAAACCCTGCCACACGTTTTT<br>ATCTCTTCAAATGCATGGAAGAAATCCCACGGTATC<br>CCTGACGAGATTATGTACGGCTATAACCAAAATAAG<br>CATTTAAAAATCTTCGCCAAACTTCGACTTAGAGTTT<br>TGTCGCAAGCTGATCGATTATTACAAAGAATGTATT<br>GACAGCTATCCTAACTATCAGATCTTCAATTTCAAA<br>TTCGCCGCTACGGAAACTTACAACGATATTTCGGAG<br>TTCTACAAAGATGTTGAACGTCAGGGGTACAAGATT<br>GAATGGTCGTACATTTCCGAGGACGATATTAATCAG<br>ATGGATCGTGACGGCCAGATTTATCTTTTTCAAATC<br>TACAACAAGGATTTTGCCCCAAACTCTAAGGGCATG<br>CAGAATTTACATACACTCTATTTAAAAAATATTTTT<br>TCAGAGGAAAACCTCTCTGATGTCGTCATTAAACTG<br>AATGGCGAGGCTGAGCTCTTCTTCCGCAAGAGCTCG<br>ATCCAACATAAACGCGGTCATAAGAAGGGTAGTGTG<br>TTGGTAAATAAGACCTATAAAACCACAGAAAAAACT<br>GAAAATGGTCAAGGCGAAATTGAAGTAATCGAGAGC<br>GTGCCGGACCAGTGTTACCTGGAGCTTGTTAAGTAC<br>TGGTCAGAGGGTGGTGTAGGTCAGTTGTCAGAAGAG<br>GCTTCCAAATACAAAGATAAAGTCAGCCACTACGCT<br>GCAACAATGGATATTGTCAAGGACCGGCGGTACACG<br>GAGGATAAGTTCTTTATTCACATGCCGATTACGATT<br>AATTTTAAAGCTGATAACCGGAACAATGTCAACGAG<br>AAAGTGCTGAAGTTTATTGCAGAAAACGATGATCTC<br>CACGTTATTGGTATTGACCGTGGGGAACGTAATCTC<br>CTGTACGTCTCAGTAATTGATTCACGTGGGCGTATT<br>GTTGAGCAGAAGTCGTTTAATATTGTTGAGAATTAC<br>GAGAGCAGTAAAAATGTGATCCGCCGCCATGATTAT<br>CGTGGGAAATTAGTAAATAAAGAGCACTATCGTAAT<br>GAGGCACGTAAGAGCTGGAAAGAAATCGGCAAAATC<br>AAGGAGATCAAAGAAGGTTATCTCAGTCAAGTTATC<br>CATGAGATTAGTAAGTTGGTATTAAAGTATAACGCC<br>ATCATCGTGATGGAAGATCTTAATTATGGCTTCAAA<br>CGCGGGCGGTTTAAAGTCGAGCGGCAGGTATACCAG<br>AAGTTCGAGACCATGCTTATTAACAAATTAGCCTAC<br>TTAGTGGACAAATCACGCGCGGTAGACGAACCGGGT<br>GGGTTATTAAAAGGCTACCAGCTGACATACGTGCCA<br>GATAACTTGGGTGAACTGGGGTCCCAGTGCGGGATC<br>ATTTTTTATGTGCCAGCAGCATACACTTCGAAAATC<br>GATCCTGTTACGGGCTTTGTAGACGTGTTTGATTTT<br>AAGGCATACTCCAATGCCGAAGCACGTTTAGATTTC<br>ATCAATAAACTGGATTGCATCCGCTATGACGCGCCG<br>CGTAACAAGTTTGAAATTGCTTTCGACTACGGTAAC<br>TTCCGGACTCATCATACAACCCTTGCAAAGACTAGC<br>TGGACTATTTTTATTCACGGCGACCGTATTAAAAAG<br>GAGCGCGGTTCTTACGGCTGGAAGGACGAAATTATC<br>GATATCGAGGCCCGTATTCGTAAGCTGTTTGAAGAC |

141

TABLE 26-continued

Sequences of exemplary engineered ABW nucleases

| Engineered Amino Acid Sequence | Engineered Nucleotide Sequence |
| --- | --- |
| | ACAGACATCGAATACGCCGATGGTCACAATTTGATC<br>GGTGACATTAACGAGCTCGAGAGTCCAATTCAAAAG<br>AAATTCGTTGGTGAGCTGTTCGACATTATCCGTTTC<br>ACTGTCCAACTGCGCAACAGCAAAAGTGAGAAATAT<br>GACGGCACCGAAAAGGAGTATGACAAAATTATTTCG<br>CCGGTAATGGACGAGGAGGGGGTTTTCTTTACAACC<br>GACAGTTATATCCGCGCAGATGGTACTGAATTACCT<br>AAAGATGCTGATGCTAACGGGGCCTATTGTATCGCG<br>CTGAAGGGTCTTTACGACGTGCTCGCGGTAAAGAAA<br>TATTGGAAGGAGGGGGAGAAGTTCGATCGGAAGTTA<br>CTTGCCATCACCAATTACAACTGGTTTGATTTCATT<br>CAGAATCGTCGCTTCGCGGCCGCAAAAAGGCCGGCG<br>GCCACGAAAAGGCCGGCCAGGCAAAAAAGAAAAAG<br>GCTAGCGGCAGCGGCGCCGGATCCCCAAAGAAGAAA<br>AGGAAGGTTGAAGACCCCAAGAAAAAGAGGAAGGTG<br>TGATAA (SEQ ID NO: 95) |
| ABW9 | MGHHHHHHSSGLVPRGSG<br>TMSDRLDVLTNQYPLSKT<br>LRFELKPVGATADWIRKH<br>NVIRYHNGKLVGKDAIRF<br>QNYKYLKKMLDEMHRLFL<br>QQALVLEPNSNQAQELTA<br>LLRAIENNYCNNNDLLAG<br>DYPSLSTDKTIKISNGLS<br>KLTTDLFDKKFEDWAYQY<br>KEDMPNFWRQDIAELEQK<br>LQVSANAKDQKFYKGIIK<br>KLKNKIQKSELKAETHKG<br>LYSPTESLQLLEWLVRRG<br>DIKLTYLEIGKENEKLNE<br>LVPLVELKDIHRNFNNFA<br>TYLSGFSKNRENVYSTKF<br>DRRSGYKATSVIARTFEQ<br>NLMFCLGNIAKWHKVTEF<br>INQANNYELLQEHGIDWN<br>KQIAALEHKLDVCLAEFF<br>ALNNFSQTLAQQGIEKYN<br>QVLAGIAEIAGQPKTQGL<br>NELINLARQKLSAKRSQL<br>PTLQLLYKQILSKGDKPF<br>IDDPKSDQELIAELNEFV<br>SSQIHGEHGAIKLINHEL<br>ESFINEARAAQQQIYVPK<br>DKLTELSLLLTGSWQAIN<br>QWRYKLFDQKQLDKQQKQ<br>YSFSLAQVERWLATEVEQ<br>QNFYQTEKERQQHKDTQP<br>ANVTTSSDGHSILTAFEQ<br>QVQTLLTNICVAAEKYRQ<br>LSDNLTAIDKQRESESSK<br>GFEQIAVIKTLLDACNEL<br>NHFLARFTVNKKDKLPED<br>RAEFWYEKLQAYIDAFPI<br>YELYNKVRNYLSKKPFST<br>EKVKINFDNSHFLSGWTA<br>DYERHSALLFKFNENYLL<br>GVVNENLSSEEEEKLKLV<br>GGEEHAKRFIYDFQKIDN<br>SNPPRVFIRSKGSSFAPA<br>VEKYQLPIGDIIDIYDQG<br>KFKTEHKKKNEAEFKDSL<br>VRLIDYFKLGFSRHDSYK<br>HYPFKWKASHQYSDIAEF<br>YAHTASFCYTLKEENINF<br>NVLRELSSAGKVYLFEIY<br>NKDFSKNKRGQGRDNLHT<br>SYWKLLFSAENLKDVVLK<br>LNGQAEIFYRPASLAETK<br>AYTHKKGEVLKHKAYSKV<br>WEALDSPIGTRLSWDDAL<br>KIPSITEKTNHNNQRVVQ<br>YNGQEIGRKAEFAIIKNR<br>RYSVDKFLFHCPITLNFK | ATGGGGCATCACCACCACCACCACTCGTCGGGTCTT<br>GTTCCACGTGGTTCTGGTACCATGTCTGATCGCCTG<br>GACGTGCTTACTAACCAATACCCATTATCGAAAACT<br>TTGCGCTTCGAATTGAAGCCGGTTGGAGCCACAGCT<br>GACTGGATTCGCAAACACAACGTTATCCGCTATCAT<br>AATGGTAAACTGGTTGGAAAGGATGCGATCCGTTTT<br>CAAAATTATAAGTATCTGAAGAAAATGCTTGATGAG<br>ATGCATCGCTTATTTCTTCAGCAAGCACTGGTGTTG<br>GAGCCAAATAGCAACCAGGCGCAGGAGTTGACCGCA<br>CTGCTGCGTGCTATTGAGAATAATTATTGCAACAAC<br>AACGACCTGCTGGCGGGCGATTATCCCAGCCTCTCT<br>ACCGATAAGACCATTAAAATCAGCAACGGCCTTAGC<br>AAGCTGACCACGGATCTGTTCGATAAGAAGTTCGAA<br>GACTGGGCATACCAATACAAAGAAGATATGCCCAAT<br>TTCTGGCGTCAAGATATTGCGGAATTAGAGCAAAAG<br>CTTCAGGTGAGTGCGAACGCAAAAGATCAAAAGTTC<br>TACAAAGGGATCATCAAGAAGCTGAAGAATAAGATC<br>CAGAAGTCTGAACTGAAAGCGGAAACGCACAAGGGC<br>TTATACTCACCTACGGAGTCACTGCAACTGCTGGAG<br>TGGCTGGTACGTCGTGGCGATATTAAACTGACTTAC<br>TTAGAGATTGGTAAAGAGAACGAGAAACTTAATGAA<br>CTGGTCCCGCTGGTCGAACTTAAGGACATTCATCGC<br>AATTTCAATAATTTCGCCACATATCTTTCTGGCTTC<br>AGCAAGAATCGTGAGAATGTGTACTCAACCAAATTT<br>GATCGTCGTTCGGGTTATAAAGCCACCAGTGTAATC<br>GCACGCACGTTCGAACAGAATTTAATGTTCTGTCTT<br>GGTAACATTGCCAAGTGGCACAAGGTGACAGAATTC<br>ATCAACCAGGCGAACAATTACGAGCTCCTGCAGGAG<br>CACGGCATCGATTGGAATAAGCAAATTGCCGCGCTG<br>GAACACAAACTGGACGTGTGTCTCGCAGAGTTCTTC<br>GCGCTTAATAACTTCTCACAAACCCTTGCACAACAG<br>GGTATCGAAAAGTATAACCAGGTCTTGGCCGGCATC<br>GCCGAGATTGCAGGCCAAACCCAAGACCCAGGGCCTG<br>AACGAACTCATTAACCTGGCCCGTCAGAAATTGTCT<br>GCCAAACGCTCACAACTGCCTACGTCCTACTTCCTT<br>TACAAACAAATCTTAAGCAAGGGTGATAAGCCATTC<br>ATCGACGATTTTAAAAGCGACCAAGAGTTGATCGCC<br>GAATTAAATGAGTTTGTAAGCAGCCAGATTCACGGA<br>GAGCATGGTGCAATCAAATTAATTAATCACGAACTT<br>GAAAGCTTTATCAATGAAGCCCCGTGCAGCAGCAA<br>CAGATTTATGTGCCCAAGGACAAGCTTACCGAATTA<br>AGTCTTCTCTTAACGGGCAGTTGGCAAGCTATTAAT<br>CAATGGCGTTACAAACTGTTCGACCAGAAACAGCTG<br>GATAAACAACAGAAACAATATTCATTTAGCCTGGCG<br>CAGGTTGAACGCTGGCTGGCAACTGAGGTTGAGCAA<br>CAAAACTTCTACCAAACCGAAAAGGAGCGCCAGCAG<br>CATAAAGATACGCAGCCGGCGAACGTCACCACCAGC<br>AGCGATGGACACAGCATTTTAACAGCATTTGAACAG<br>CAGGTGCAGACCTTATTAACCAACATCTGTGTTGCT<br>GCCGAGAAATATCGCCAATTAAGTGATAATCTCACA<br>GCCATCGATAAACAACGCGAGAGCGAATCAAGTAAG<br>GGATTCGAGCAAATCGCGGTGATTAAAACCTTGCTG<br>GACGCGTGTAACGAGCTGAATCACTTTCTGGCACGC<br>TTCACGGTCAACAAGAAGGACAAACTCCCCGAAGAT<br>CGCGCAGAATTTTGGTATGAAAAGTTACAAGCGTAC<br>ATTGACGCGTTTCCGATCTACGAGCTGTATAATAAA<br>GTGCGTAATTACTTAAGCAAGAAGCCGTTTAGCACT |

142

TABLE 26-continued

Sequences of exemplary engineered ABW nucleases

| Engineered Amino Acid Sequence | Engineered Nucleotide Sequence |
|---|---|
| ANGQDNINARVNQFLANN KKINIIGIDRGEKHLLYI SVINQQGEVLHQESENTI TNSYQTANGEKRQVVTDY HQKLDMSEDKRDKARKSW STIENIKELKAGYLSHVV HRLAQLIIEFNAIVALED LNHGFKRGRFKIEKQVYQ KFEKALIDKLSYLAFKDR TSCLETGHYLNAFQLTSK FKGFNNLGKQSGILFYVN ADYTSTTDPLTGYIKNVY KTYSSVKDSTEFWQRFNS IRYIASENRFEFSYDLAD LKQKSLESKTKQTPLAKT QWTVSSHVTRSYYNQQTK QHELFEVTARIQQLLSKA EISYQHQNDLIPALASCQ SKALHKELIWLFNSILTM RVTDSSKPSATSENDFIL SPVAPYFDSRNLNKQLPE NGDANGAYNIARKGIMLL ERIGDFVPEGNKKYPDLL IRNNDWQNFVQRPEMVNK QKKKLVKLKTEYSNGSLF NDLAFKAAAKRPAATKKA GQAKKKKASGSGAGSPKK KRKVEDPKKKRKV (SEQ ID NO: 107) | GAGAAAGTCAAAATTAATTTTGACAATTCCCATTTC CTGTCGGGTTGGACGGCGGACTATGAGCGTCACAGC GCCTTATTATTCAAATTTAATGAAAATTACCTGCTG GGTGTAGTGAATGAGAACTTAAGCAGCGAGGAAGAA GAAAAGCTGAAGCTCGTGGGCGGCGAAGAACATGCC AAGCGCTTCATTTATGATTTTCAGAAAATCGACAAC TCAAACCCACCGCGCGTTTTCATTCGTAGCAAGGGG TCATCGTTCGCACCTGCGGTCGAAAAGTATCAGTTA CCGATTGGCGATATCATTGACATTTACGATCAGGGT AAATTTAAGACAGAACACAAGAAGAAGAATGAGGCC GAGTTTAAAGACAGTCTGGTACGTTTGATCGATTAT TTTAAGCTGGGCTTCTCTCGCCATGACAGCTATAAG CACTACCCATTCAAGTGGAAAGCCAGTCATCAATAT AGCGACATTGCGGAATTTTACGCTCATACCGCCTCA TTTTGTTACACGCTTAAGGAAGAAAACATCAATTTT AACGTTCTGCGTGAGTTGTCGTCGGCGGGCAAAGTA TATCTCTTCGAAATTTACAATAAGGATTTCTCAAAG AACAAGCGCGGCCAAGGACGCGACAACTTGCATACC AGTTATTGGAAGTTGCTGTTCTCGGCTGAGAACCTG AAGGATGTTGTGCTGAAATTAAACGGCCAAGCGGAG ATCTTTTACCGCCCAGCGTCTTTGGCCGAAACCAAG GCCTACACCCATAAGAAAGGGGAAGTACTGAAACAT AAGGCTTATAGCAAAGTGTGGGAAGCCCTGGATTCT CCCATTGGCACCCGCCTGAGCTGGGACGATGCTTTA AAGATCCCGTCTATTACCGAGAAGACCAATCACAAT AATCAGCGTGTTGTCCAGTACAACGGCCAAGAAATT GGCCGCAAAGCGGAGTTCGCTATTATCAAGAACCGC CGTTATTCCGTCGATAAATTCCTCTTTCACTGCCCG ATTACACTCAACTTCAAGGCGAACGGCCAGGACAAC ATTAACGCACGCGTTAATCAATTCCTGGCAAATAAC AAGAAGATCAACATTATTGGAATTGACCGTGGTGAA AAGCATTTACTGTATATCAGCGTGATTAATCAACAA GGCGAAGTCCTGCATCAGGAAAGCTTCAATACAATC ACGAATTCATATCAGACCGCCAATGGCGAGAAACGC CAAGTAGTCACTGACTATCACCAGAAGTTGGACATG AGCGAGGACAAACGCGATAAAGCACGTAAGAGCTGG AGTACAATCGAAAATATCAAAGAGCTGAAGGCGGGG TATCTGAGCCACGTTGTACATCGCCTCGCGCAACTG ATTATCGAATTTAATGCCATTGTTGCGTTGGAAGAT CTTAACCACGGGTTCAAACGCGGACGTTTTAAAATC GAAAAGCAAGTGTATCAGAAGTTCGAAAAGGCGCTG ATCGACAAATTGAGCTACTTAGCGTTTAAGGATCGC ACGTCGTGTCTGGAAACTGGACATTACTTGAATGCC TTTCAATTAACCTCAAAGTTCAAAGGCTTTAACAAC CTTGGCAAGCAATCCGGGATTTTGTTCTACGTTAAC GCCGATTACACGAGCACCACGGATCCCTTAACAGGC TATATTAAGAACGTATACAAAACCTACTCCTCGGTG AAGGATTCGACCGAATTTTGGCAGCGCTTTAACTCT ATCCGCTATATTGCGAGCGAGAACCGTTTTGAATTT AGCTACGACTTAGCGGACCTGAAACAGAAGTCGCTC GAGAGTAAAACCAAACAGACCCCTCTCGCCAAGACC CAATGGACGGTCTCTAGCCACGTTACCCGTTCCTAT TACAACCAGCAGACGAAGCAACATGAGTTATTCGAA GTGACAGCGCGCATTCAGCAATTGCTTAGCAAAGCA GAAATCAGCTATCAACATCAAAACGACTTGATCCCT GCGTTAGCATCATGTCAAAGTAAGGCGTTACACAAG GAGTTGATTTGGCTGTTCAACAGCATCCTGACTATG CGCGTCACGGACTCAAGCAAACCGTCCGCGACCTCG GAGAATGATTTTATCCTGAGCCCGGTAGCGCCGTAC TTCGACTCCCGCAATCTGAATAAGCAGCTGCCGGAA AACGGCGACGCGAACGGCGCATACAATATCGCTCGT AAAGGTATCATGCTTCTGGAACGTATCGGGGACTTC GTCCCGGAAGGTAACAAGAAGTACCCCGATTTACTG ATCCGCAATAATGACTGGCAGAATTTTGTACAACGC CCGGAGATGGTGAACAAGCAGAAGAAGAAACTCGTG AAGTTGAAAACGGAATACTCTAATGGCAGCCTCTTC AATGATTTGGCGTTTAAGGCCGCAGCTAAGCGCCCC GCCGCGACTAAGAAAGCGGGTCAAGCGAAGAAGAAG AAAGCGTCGGGGTCGGGAGCGGGCAGTCCGAAGAAG AAGCGTAAAGTAGAGGATCCGAAGAAGAAACGCAAA GTATAATAA (SEQ ID NO: 108) |

In some embodiments, nuclease constructs disclosed herein can have a polypeptide sequence having at least 85% homology to the polypeptide represented by SEQ ID NO: 94 (ABW8), 29 (ABW3), 81 (ABW7), 107 (ABW9), 3 (ABW1), 16 (ABW2), 42 (ABW4), 55 (ABW5), and/or 68 (AWBW6) of International (PCT) Publication No. WO2021/108324. In some embodiments, nuclease constructs herein can have a polynucleotide sequence at least 85% homologous to the polynucleotide encoding the polypeptide having a polynucleotide represented by SEQ ID NO: 95-104 (ABW8 variants 1-10), 30-39 (ABW3 variants 1-10), 82-91 (ABW7 variants 1-10), 108-117 (ABW9 variants 1-10), 4-13 (ABW1 variants 1-10), 17-26 (ABW2 variants 1-10), 43-52 (ABW4 variants 1-10), 56-65 (ABW5 variants 1-10), and/or 69-78 (ABW6 variants 1-10)) of International (PCT) Publication No. WO2021/108324.

In some embodiments, nuclease constructs herein having a polypeptide of at least 85% homology to the polypeptide represented SEQ ID NO: 94) of International (PCT) Publication No. WO2021/108324. (ABW8) can have increased activity and/or editing accuracy compared to other nuclease constructs. In some embodiments, nuclease constructs herein having a polypeptide of at least 85% homology to the polypeptide represented by SEQ ID NO: 94 (ABW8), 29 (ABW3), 81 (ABW7) and/or 107 (ABW9) can have increased enzymatic activity and/or editing efficiency and/or accuracy compared to other nuclease constructs such as control nuclease constructs or native sequence-containing nucleases.

In some embodiments, nuclease constructs disclosed herein having a polynucleotide encoding a polypeptide having a polynucleotide of at least 85% homology to a polynucleotide represented by SEQ ID NO: 95-104 (ABW8 variants 1-10) can have increased enzymatic activity and/or editing efficiency and/or accuracy compared to control nuclease constructs or nuclease constructs having native sequences. In some embodiments, nuclease constructs disclosed herein having a polynucleotide encoding a polypeptide of at least 85% homology to a polynucleotide represented by SEQ ID NO: 95-104 (ABW8 variants 1-10), 30-39 (ABW3 variants 1-10) or 82-91 (ABW7 variants 1-10) can have increased activity (e.g., editing and/or efficiency) compared to control nuclease constructs or other nuclease constructs.

More type V-A Cas nucleases and their corresponding naturally occurring CRISPR-Cas systems can be identified by computational and experimental methods known in the art, e.g., as described in U.S. Pat. No. 9,790,490 and Shmakov et al. (2015) MOL. CELL, 60:385. Exemplary computational methods include analysis of putative Cas proteins by homology modeling, structural BLAST, PSI-BLAST, or HHPred, and analysis of putative CRISPR loci by identification of CRISPR arrays. Exemplary experimental methods include in vitro cleavage assays and in-cell nuclease assays (e.g., the Surveyor assay) as described in Zetsche et al. (2015) CELL, 163:759.

In certain embodiments, the Cas nuclease directs cleavage of one or both strands at the target locus, such as the target strand (i.e., the strand having the target nucleotide sequence that hybridizes with a single guide nucleic acid or modified dual guide nucleic acids) and/or the non-target strand. In certain embodiments, the Cas nuclease directs cleavage of one or both strands within 1, 2, 3, 4, 5, 6, 7, 8, 9, 10, 15, 20, 25, 50, 100, 200, 500, or more nucleotides from the first or last nucleotide of the target nucleotide sequence or its complementary sequence. In certain embodiments, the cleavage is staggered, i.e. generating sticky ends. In certain embodiments, the cleavage generates a staggered cut with a 5' overhang. In certain embodiments, the cleavage generates a staggered cut with a 5' overhang of 1 to 5 nucleotides, e.g., of 4 or 5 nucleotides. In certain embodiments, the cleavage site is distant from the PAM, e.g., the cleavage occurs after the 18th nucleotide on the non-target strand and after the 23rd nucleotide on the target strand.

In certain embodiments, the engineered, non-naturally occurring system of the present invention further comprises the Cas nuclease that a complex comprising the targeter nucleic acid and the modulator nucleic acid is capable of activating. In other embodiments, the engineered, non-naturally occurring system of the present invention further comprises a Cas protein that is related to the Cas nuclease that a complex comprising the targeter nucleic acid and the modulator nucleic acid is capable of activating. For example, in certain embodiments, the Cas protein comprises an amino acid sequence at least 80% (e.g., at least 85%, at least 90%, at least 91%, at least 92%, at least 93%, at least 94%, at least 95%, at least 96%, at least 97%, at least 98%, or at least 99%) identical to the Cas nuclease. In certain embodiments, the Cas protein comprises a nuclease-inactive mutant of the Cas nuclease. In certain embodiments, the Cas protein further comprises an effector domain.

In certain embodiments, the Cas protein lacks substantially all DNA cleavage activity. Such a Cas protein can be generated by introducing one or more mutations to an active Cas nuclease (e.g., a naturally occurring Cas nuclease). A mutated Cas protein is considered to lack substantially all DNA cleavage activity when the DNA cleavage activity of the protein has at most 25%, at most 10%, at most 5%, at most 1%, at most 0.1%, at most 0.01%, or less of the DNA cleavage activity of the corresponding non-mutated form, for example, nil or negligible as compared with the non-mutated form. Thus, the Cas protein may comprise one or more mutations (e.g., a mutation in the RuvC domain of a type V-A Cas protein) and be used as a generic DNA binding protein with or without fusion to an effector domain. Exemplary mutations include D908A, E993A, and D1263A with reference to the amino acid positions in AsCpf1; D832A, E925A, and D1180A with reference to the amino acid positions in LbCpf1; and D917A, E1006A, and D1255A with reference to the amino acid position numbering of the FnCpf1. More mutations can be designed and generated according to the crystal structure described in Yamano et al. (2016) CELL, 165:949.

It is understood that the Cas protein, rather than losing nuclease activity to cleave all DNA, may lose the ability to cleave only the target strand or only the non-target strand of a double-stranded DNA, thereby being functional as a nickase (see, Gao et al. (2016) CELL RES., 26:901). Accordingly, in certain embodiments, the Cas nuclease is a Cas nickase. In certain embodiments, the Cas nuclease has the activity to cleave the non-target strand but lacks substantially the activity to cleave the target strand, e.g., by a mutation in the Nuc domain. In certain embodiments, the Cas nuclease has the cleavage activity to cleave the target strand but lacks substantially the activity to cleave the non-target strand.

In other embodiments, the Cas nuclease has the activity to cleave a double-stranded DNA and result in a double-strand break.

Cas proteins that lack substantially all DNA cleavage activity or have the ability to cleave only one strand may also be identified from naturally occurring systems. For example, certain naturally occurring CRISPR-Cas systems may retain the ability to bind the target nucleotide sequence but lose entire or partial DNA cleavage activity in eukaryotic (e.g., mammalian or human) cells. Such type V-A proteins are disclosed, for example, in Kim et al. (2017) ACS SYNTH. BIOL. 6 (7): 1273-82 and Zhang et al. (2017) CELL DISCOV. 3:17018.

The activity of the Cas protein (e.g., Cas nuclease) can be altered, thereby creating an engineered Cas protein. In certain embodiments, the altered activity of the engineered Cas protein comprises increased targeting efficiency and/or decreased off-target binding. While not wishing to be bound by theory, it is hypothesized that off-target binding can be recognized by the Cas protein, for example, by the presence of one or more mismatches between the spacer sequence and the target nucleotide sequence, which may affect the stability and/or conformation of the CRISPR-Cas complex. In certain embodiments, the altered activity comprises modified binding, e.g., increased binding to the target locus (e.g., the target strand or the non-target strand) and/or decreased binding to off-target loci. In certain embodiments, the altered activity comprises altered charge in a region of the protein that associates with a single guide nucleic acid or dual guide nucleic acids, e.g., modified dual guide nucleic acids as described herein. In certain embodiments, the altered activity of the engineered Cas protein comprises altered charge in a region of the protein that associates with the target strand and/or the non-target strand. In certain embodiments, the altered activity of the engineered Cas protein comprises altered charge in a region of the protein that associates with an off-target locus. The altered charge can include decreased positive charge, decreased negative charge, increased positive charge, and increased negative charge. For example, decreased negative charge and increased positive charge may generally strengthen the binding to the nucleic acid(s) whereas decreased positive charge and increased negative charge may weaken the binding to the nucleic acid(s). In certain embodiments, the altered activity comprises increased or decreased steric hindrance between the protein and a single guide nucleic acid or dual guide nucleic acids, e.g., modified dual guide nucleic acids as described herein. In certain embodiments, the altered activity comprises increased or decreased steric hindrance between the protein and the target strand and/or the non-target strand. In certain embodiments, the altered activity comprises increased or decreased steric hindrance between the protein and an off-target locus. In certain embodiments, the modification or mutation comprises a substitution of Lys, His, Arg, Glu, Asp, Ser, Gly, or Thr. In certain embodiments, the modification or mutation comprises a substitution with Gly, Ala, Ile, Glu, or Asp. In certain embodiments, the modification or mutation comprises an amino acid substitution in the groove between the WED and RuvC domain of the Cas protein (e.g., a type V-A Cas protein).

In certain embodiments, the altered activity of the engineered Cas protein comprises increased nuclease activity to cleave the target locus. In certain embodiments, the altered activity of the engineered Cas protein comprises decreased nuclease activity to cleave an off-target locus. In certain embodiments, the altered activity of the engineered Cas protein comprises altered helicase kinetics. In certain embodiments, the engineered Cas protein comprises a modification that alters formation of the CRISPR complex.

In certain embodiments, a protospacer adjacent motif (PAM) or PAM-like motif directs binding of the Cas protein complex to the target locus. Many Cas proteins have PAM specificity. The precise sequence and length requirements for the PAM differ depending on the Cas protein used. PAM sequences are typically 2-5 base pairs in length and are adjacent to (but located on a different strand of target DNA from) the target nucleotide sequence. PAM sequences can be identified using any suitable method, e.g., a method known in the art, such as testing cleavage, targeting, or modification of oligonucleotides having the target nucleotide sequence and different PAM sequences.

In one embodiment, the Cas protein is MAD7 and the PAM is TTTN, wherein N is A, C, G, or T. In one embodiment, the Cas protein is MAD7 and the PAM is CTTN, wherein N is A, C, G, or T. In another embodiment, the Cas protein is AsCpf1 and the PAM is TTTN, wherein N is A, C, G, or T. In another embodiment, the Cas protein is FnCpf1 and the PAM is 5' TTN, wherein N is A, C, G, or T. PAM sequences for certain other type V-A Cas proteins are disclosed in Zetsche et al. (2015) CELL, 163:759 and U.S. Pat. No. 9,982,279. Further, engineering of the PAM Interacting (PI) domain of a Cas protein may allow programing of PAM specificity, improve target site recognition fidelity, and increase the versatility of the engineered, non-naturally occurring system. Exemplary approaches to alter the PAM specificity of Cpf1 is described in Gao et al. (2017) NAT. BIOTECHNOL., 35:789.

In certain embodiments, the engineered Cas protein comprises a modification that alters the Cas protein specificity in concert with modification to targeting range. Cas mutants can be designed to have increased target specificity as well as accommodating modifications in PAM recognition, for example by choosing mutations that alter PAM specificity (e.g., in the PI domain) and combining those mutations with groove mutations that increase (or if desired, decrease) specificity for the on-target locus versus off-target loci. The Cas modifications described herein can be used to counter loss of specificity resulting from alteration of PAM recognition, enhance gain of specificity resulting from alteration of PAM recognition, counter gain of specificity resulting from alteration of PAM recognition, or enhance loss of specificity resulting from alteration of PAM recognition.

In certain embodiments, the engineered Cas protein comprises one or more nuclear localization signal (NLS) motifs. In certain embodiments, the engineered Cas protein comprises at least 2 (e.g., at least 3, at least 4, at least 5, at least 6, at least 7, at least 8, at least 9, or at least 10) NLS motifs. Non-limiting examples of NLS motifs include: the NLS of SV40 large T-antigen, having the amino acid sequence of PKKKRKV (SEQ ID NO: 23); the NLS from nucleoplasmin, e.g., the nucleoplasmin bipartite NLS having the amino acid sequence of KRPAATKKAGQAKKKK (SEQ ID NO: 24); the c-myc NLS, having the amino acid sequence of PAAKRVKLD (SEQ ID NO: 25) or RORRNELKRSP (SEQ ID NO: 26); the hRNPA1 M9 NLS, having the amino acid sequence of NQSSNFGPMKGGNFG-GRSSGPYGGGGQYFAKPRNOGGY (SEQ ID NO: 27); the importin-α IBB domain NLS, having the amino acid sequence of RMRIZFKNKGKDTAELRRRRVEVS-VELRKAKKDEQILKRRNV (SEQ ID NO: 28); the myoma T protein NLS, having the amino acid sequence of VSRKRPRP (SEQ ID NO: 793) or PPKKARED (SEQ ID NO: 794); the human p53 NLS, having the amino acid sequence of PQPKKKPL (SEQ ID NO: 31); the mouse c-abl IV NLS, having the amino acid sequence of SALIKKKKK-MAP (SEQ ID NO: 32); the influenza virus NS1 NLS, having the amino acid sequence of DRLRR (SEQ ID NO: 33) or PKQKKRK (SEQ ID NO: 34); the hepatitis virus δ antigen NLS, having the amino acid sequence of RKLKK-KIKKL (SEQ ID NO: 35); the mouse Mx1 protein NLS, having the amino acid sequence of REKKKFLKRR (SEQ ID NO: 36); the human poly (ADP-ribose) polymerase NLS, having the amino acid sequence of KRKGDEVDGVDE-VAKKKSKK (SEQ ID NO: 37); the human glucocorticoid receptor NLS, having the amino acid sequence of RKCLQAGMNLEARKTKK (SEQ ID NO: 38), and synthetic NLS motifs such as PAAKKKKLD (SEQ ID NO: 39).

In general, the one or more NLS motifs are of sufficient strength to drive accumulation of the Cas protein in a detectable amount in the nucleus of a eukaryotic cell. The strength of nuclear localization activity may derive from the number of NLS motif(s) in the Cas protein, the particular NLS motif(s) used, the position(s) of the NLS motif(s), or a combination of these factors. In certain embodiments, the engineered Cas protein comprises at least 1 (e.g., at least 2, at least 3, at least 4, at least 5, at least 6, at least 7, at least 8, at least 9, or at least 10) NLS motif(s) at or near the N-terminus (e.g., within at least 1, 2, 3, 4, 5, 10, 15, 20, 25, 30, 40, 50, or more amino acids along the polypeptide chain from the N-terminus). In certain embodiments, the engineered Cas protein comprises at least 1 (e.g., at least 2, at least 3, at least 4, at least 5, at least 6, at least 7, at least 8, at least 9, or at least 10) NLS motif(s) at or near the C-terminus (e.g., within at least 1, 2, 3, 4, 5, 10, 15, 20, 25, 30, 40, 50, or more amino acids along the polypeptide chain from the C-terminus). In certain embodiments, the engineered Cas protein comprises at least 1 (e.g., at least 2, at least 3, at least 4, at least 5, at least 6, at least 7, at least 8, at least 9, or at least 10) NLS motif(s) at or near the C-terminus and at least 1 (e.g., at least 2, at least 3, at least 4, at least 5, at least 6, at least 7, at least 8, at least 9, or at least 10) NLS motif(s) at or near the N-terminus. In certain embodiments, the engineered Cas protein comprises one, two, or three NLS motifs at or near the C-terminus. In certain embodiments, the engineered Cas protein comprises one NLS motif at or near the N-terminus and one, two, or three NLS motifs at or near the C-terminus. In certain embodiments, the engineered Cas protein comprises a nucleoplasmin NLS at or near the C-terminus.

Detection of accumulation in the nucleus may be performed by any suitable technique. For example, a detectable marker may be fused to the nucleic acid-targeting protein, such that location within a cell may be visualized. Cell nuclei may also be isolated from cells, the contents of which may then be analyzed by any suitable process for detecting the protein, such as immunohistochemistry, Western blot, or enzyme activity assay. Accumulation in the nucleus may also be determined indirectly, such as by an assay that detects the effect of the nuclear import of a Cas protein complex (e.g., assay for DNA cleavage or mutation at the target locus, or assay for altered gene expression activity) as compared to a control not exposed to the Cas protein or exposed to a Cas protein lacking one or more of the NLS motifs.

The Cas protein may comprise a chimeric Cas protein, e.g., a Cas protein having enhanced function by being a chimera. Chimeric Cas proteins may be new Cas proteins containing fragments from more than one naturally occurring Cas proteins or variants thereof. For example, fragments of multiple type V-A Cas homologs (e.g., orthologs) may be fused to form a chimeric Cas protein. In certain embodiments, the chimeric Cas protein comprises fragments of Cpf1 orthologs from multiple species and/or strains.

In certain embodiments, the Cas protein comprises one or more effector domains. The one or more effector domains may be located at or near the N-terminus of the Cas protein and/or at or near the C-terminus of the Cas protein. In certain embodiments, an effector domain comprised in the Cas protein is a transcriptional activation domain (e.g., VP64), a transcriptional repression domain (e.g., a KRAB domain or an SID domain), an exogenous nuclease domain (e.g., FokI), a deaminase domain (e.g., cytidine deaminase or adenine deaminase), or a reverse transcriptase domain (e.g., a high fidelity reverse transcriptase domain). Other activities of effector domains include but are not limited to methylase activity, demethylase activity, transcription release factor activity, translational initiation activity, translational activation activity, translational repression activity, histone modification (e.g., acetylation or demethylation) activity, single-stranded RNA cleavage activity, double-strand RNA cleavage activity, single-strand DNA cleavage activity, double-strand DNA cleavage activity, and nucleic acid binding activity.

In certain embodiments, the Cas protein comprises one or more protein domains that enhance homology-directed repair (HDR) and/or inhibit non-homologous end joining (NHEJ). Exemplary protein domains having such functions are described in Jayavaradhan et al. (2019) NAT. COMMUN. 10 (1): 2866 and Janssen et al. (2019) MOL. THER. NUCLEIC ACIDS 16:141-54. In certain embodiments, the Cas protein comprises a dominant negative version of p53-binding protein 1 (53BP1), for example, a fragment of 53BP1 comprising a minimum focus forming region (e.g., amino acids 1231-1644 of human 53BP1). In certain embodiments, the Cas protein comprises a motif that is targeted by APC-Cdh1, such as amino acids 1-110 of human Geminin, thereby resulting in degradation of the fusion protein during the HDR non-permissive G1 phase of the cell cycle.

In certain embodiments, the Cas protein comprises an inducible or controllable domain. Non-limiting examples of inducers or controllers include light, hormones, and small molecule drugs. In certain embodiments, the Cas protein comprises a light inducible or controllable domain. In certain embodiments, the Cas protein comprises a chemically inducible or controllable domain.

In certain embodiments, the Cas protein comprises a tag protein or peptide for ease of tracking or purification. Non-limiting examples of tag proteins and peptides include fluorescent proteins (e.g., green fluorescent protein (GFP), YFP, RFP, CFP, mCherry, tdTomato), HIS tags (e.g., 6×His tag), hemagglutinin (HA) tag, FLAG tag, and Myc tag.

In certain embodiments, the Cas protein is conjugated to a non-protein moiety, such as a fluorophore useful for genomic imaging. In certain embodiments, the Cas protein is covalently conjugated to the non-protein moiety. The terms "CRISPR-Associated protein," "Cas protein," "Cas," "CRISPR-Associated nuclease," and "Cas nuclease" as used herein can include such conjugates despite the presence of one or more non-protein moieties.

II. METHODS OF TARGETING, EDITING, AND/OR MODIFYING GENOMIC DNA

The engineered, non-naturally occurring systems disclosed herein are useful for targeting, editing, and/or modifying a target nucleic acid, such as a DNA (e.g., genomic DNA) in a cell or organism. Accordingly, in one aspect, the present invention provides a method of modifying a target nucleic acid (e.g., DNA) having a target nucleotide sequence, the method comprising contacting the target nucleic acid with the engineered, non-naturally occurring system disclosed herein, for example in sections IA, IA1, IB, or IC, thereby resulting in modification of the target nucleic acid.

The engineered, non-naturally occurring system can be contacted with the target nucleic acid as a complex. Accordingly, in certain embodiments, the method comprises contacting the target nucleic acid with a modified guide CRISPR-Cas complex, such as a modified dual guide CRISPR-Cas complex comprising (a) a targeter nucleic acid comprising (i) a spacer sequence designed to hybridize with the target nucleotide sequence with a 3' end and (ii) a targeter stem sequence with, optionally, a 5' end; (b) a modulator nucleic acid comprising a modulator stem sequence complementary to the targeter stem sequence with, optionally, a 3' end and a 5' end with, optionally, a 5' sequence, e.g., tail sequence, and (c) a Cas protein, e.g., a Cas nuclease, wherein the targeter nucleic acid and the modulator nucleic acid are joined in certain embodiments and separate nucleic acids in other embodiments, and wherein one or more nucleotides or internucleotide linkages, such as 1-5 or more than 5 nucleotides or internucleotide linkages, e.g., 1, 2, 3, 4, 5 or more than 5 nucleotides or internucleotide linkages, at or near the 3' end of the targeter nucleotide, at or near the 5' end of the targeter stem sequence (if present), at or near the 3' end of the modulator nucleic acid (if present), at or near the 5' end of the 5' sequence, e.g., tail sequence, or a combination thereof, are modified; thereby resulting in modification of the target nucleic acid. Exemplary modified guide nucleic acid CRISPR-Cas complexes are described in Section IC, using modified guide nucleic acids described in sections IA, IA1, and IB, and nucleases described in section IC, and any of these may be used under suitable conditions. In some cases, the targeter nucleic acid and the modulator nucleic acid form a complex that is capable of activating a Cas nuclease that, in a naturally occurring system, is activated by a single crRNA in the absence of a tracrRNA. In certain embodiments, the Cas protein comprises an amino acid sequence at least 80% (e.g., at least 85%, at least 90%, at least 91%, at least 92%, at least 93%, at least 94%, at least 95%, at least 96%, at least 97%, at least 98%, or at least 99%) identical to the Cas nuclease.

In certain embodiments, the Cas nuclease is a Type I, II, III, IV, V, or V Cas nuclease. In certain embodiments, the Cas nuclease is a type V-A, type V-C, or type V-D Cas nuclease. In certain embodiments, the Cas nuclease is a type V-A Cas nuclease. In certain embodiments, the target nucleic acid further comprises a cognate PAM positioned relative to the target nucleotide sequence such that (a) the modified dual guide CRISPR-Cas complex binds the target nucleic acid; or (b) the Cas nuclease is activated when the modified guide CRISPR-Cas complex, e.g., modified dual guide CRISPR-Cas complex, binds the target nucleic acid.

The modified guide CRISPR-Cas complex, e.g., modified dual guide CRISPR-Cas complex may be delivered to a cell by introducing a pre-formed ribonucleoprotein (RNP) complex into the cell. Alternatively, one or more components of the modified guide CRISPR-Cas complex, e.g., modified dual guide CRISPR-Cas complex may be expressed in the cell; it will be appreciated that segments containing modified nucleotides should be introduced into the cells, but unmodified segments can be expressed in the cell. Exemplary methods of delivery are known in the art and described in, for example, U.S. Pat. Nos. 10,113,167, 8,697,359, 10,570,418, 11,125,739, 10,829,787, and 11,118,194, and U.S. Patent Application Publication Nos. 2015/0344912, 2018/0119140, and 2018/0282763.

It is understood that contacting a DNA (e.g., genomic DNA) in a cell with a modified dual guide CRISPR-Cas complex does not require delivery of all components of the complex into the cell. For examples, one or more of the components may be pre-existing in the cell. In certain embodiments, the cell (or a parental/ancestral cell thereof) has been engineered to express the Cas protein, and the targeter nucleic acid (or a nucleic acid comprising a regulatory element operably linked to a nucleotide sequence encoding the targeter nucleic acid) and the modulator nucleic acid (or a nucleic acid comprising a regulatory element operably linked to a nucleotide sequence encoding the modulator nucleic acid) are delivered into the cell, e.g., where one or the other, or both, contains one or more modified nucleotides or internucleotide linkages at or near the 3' ends, at or near the 5' ends, or at or near both ends. In certain embodiments, the cell (or a parental/ancestral cell thereof) has been engineered to express the modulator nucleic acid, and the Cas protein (or a nucleic acid comprising a regulatory element operably linked to a nucleotide sequence encoding the Cas protein) and the targeter nucleic acid (or a nucleic acid comprising a regulatory element operably linked to a nucleotide sequence encoding the targeter nucleic acid) are delivered into the cell, where the targeter nucleic acid contains one or more modified nucleotides at or near the 3' and/or 5' ends. In certain embodiments, the cell (or a parental/ancestral cell thereof) has been engineered to express the Cas protein and the targeter nucleic acid, and the modulator nucleic acid (or a nucleic acid comprising a regulatory element operably linked to a nucleotide sequence encoding the modulator nucleic acid) is delivered into the cell, where the modulator nucleic acid contains one or more modified nucleotides at or near the 3' and/or 5' ends.

In certain embodiments, the target DNA is in the genome of a target cell. Accordingly, in another aspect, the present invention provides a cell comprising the non-naturally occurring system or a CRISPR expression system described herein. In certain embodiments, the cell is an immune cell. In certain embodiments, the cell is a T cell. See following paragraph and section IVB for more potential cells to be modified. In addition, the present invention provides a cell whose genome has been modified by the modified dual guide CRISPR-Cas system or complex disclosed herein.

The target cells can be mitotic or post-mitotic cells from any organism, such as a bacterial cell, an archaeal cell, a cell of a single-cell eukaryotic organism, a plant cell, an algal cell, e.g., *Botryococcus braunii, Chlamydomonas reinhardtii, Nannochloropsis gaditana, Chlorella pyrenoidosa, Sargassum patens C. Agardh*, and the like, a fungal cell (e.g., a yeast cell), an animal cell, a cell from an invertebrate animal (e.g., fruit fly, enidarian, echinoderm, nematode, etc.), a cell from a vertebrate animal (e.g., fish, amphibian, reptile, bird, mammal), a cell from a mammal, a cell from a rodent, or a cell from a human. The types of target cells include but are not limited to a stem cell (e.g., an embryonic stem (ES) cell, an induced pluripotent stem (iPS) cell, a germ cell), a somatic cell (e.g., a fibroblast, a hematopoietic cell, a T lymphocyte (e.g., $CD8^+$ T lymphocyte), an NK cell, a neuron, a muscle cell, a bone cell, a hepatocyte, a pancreatic cell), an in vitro or in vivo embryonic cell of an embryo at any stage (e.g., a 1-cell, 2-cell, 4-cell, 8-cell; stage zebrafish embryo). Cells may be from established cell lines or may be primary cells (i.e., cells and cells cultures that have been derived from a subject and allowed to grow in vitro for a limited number of passages of the culture). For example, primary cultures are cultures that may have been passaged within 0 times, 1 time, 2 times, 4 times, 5 times, 10 times, or 15 times, but not enough times to go through the crisis stage. Typically, the primary cell lines of the present invention are maintained for fewer than 10 passages in vitro. If the cells are primary cells, they may be harvested from an individual by any suitable method. For example, leukocytes may be harvested by apheresis, leukocytapheresis, or density gradient separation, while cells from tissues such as skin, muscle, bone marrow, spleen, liver, pancreas, lung, intestine, or stomach can be harvested by biopsy. The harvested cells may be used immediately, or may be stored under frozen conditions with a cryopreservative and thawed at a later time in a manner as commonly known in the art.

A. Ribonucleoprotein (RNP) Delivery and "Cas RNA" Delivery

The engineered, non-naturally occurring system disclosed herein can be delivered into a cell by suitable methods known in the art, including but not limited to ribonucleoprotein (RNP) delivery and "Cas RNA" delivery described below.

In certain embodiments, a modified guide CRISPR-Cas complex, e.g., modified dual guide CRISPR-Cas system including a targeter nucleic acid, a modulator nucleic acid, where the 5' and/or 3' ends of one or both of the targeter and modulator nucleic acids contain one or more, e.g., 1-5 or more than 5, such as 1, 2, 3, 4, 5, or more than 5 modified nucleotides or internucleotide linkages, and a Cas protein can be combined into a RNP complex and then delivered into the cell as a pre-formed complex. Exemplary modified guide nucleic acid CRISPR-Cas complexes are described in Section IC, using modified guide nucleic acids described in sections IA, IA1, and IB, and nucleases described in section IC, and any of these may be used under suitable conditions. This method is suitable for active modification of the genetic or epigenetic information in a cell during a limited time period. For example, where the Cas protein has nuclease activity to modify the genomic DNA of the cell, the nuclease activity only needs to be retained for a period of time to allow DNA cleavage, and prolonged nuclease activity may increase off-targeting. Similarly, certain epigenetic modifications can be maintained in a cell once established and can be inherited by daughter cells.

A "ribonucleoprotein" or "RNP," as used herein, includes a complex comprising a nucleoprotein and a ribonucleic acid. A "nucleoprotein" as used herein includes a protein capable of binding a nucleic acid (e.g., RNA, DNA). Where the nucleoprotein binds a ribonucleic acid it is referred to as "ribonucleoprotein." The interaction between the ribonucleoprotein and the ribonucleic acid may be direct, e.g., by covalent bond, or indirect, e.g., by non-covalent bond (e.g., electrostatic interactions (e.g., ionic bond, hydrogen bond, halogen bond), van der Waals interactions (e.g., dipole-dipole, dipole-induced dipole, London dispersion), ring stacking (pi effects), hydrophobic interactions, and the like). In certain embodiments, the ribonucleoprotein includes an RNA-binding motif non-covalently bound to the ribonucleic acid. For example, positively charged aromatic amino acid residues (e.g., lysine residues) in the RNA-binding motif may form electrostatic interactions with the negative nucleic acid phosphate backbones of the RNA.

To ensure efficient loading of the Cas protein, the targeter nucleic acid and the modulator nucleic acid can be provided in excess molar amount (e.g., at least 1 fold, at least 1.5 fold. at least 2 fold, at least 3 fold, at least 4 fold, or at least 5 fold) relative to the Cas protein. In certain embodiments, the targeter nucleic acid and the modulator nucleic acid are annealed under suitable conditions prior to complexing with the Cas protein. In other embodiments, the targeter nucleic acid, the modulator nucleic acid, and the Cas protein are directly mixed together to form an RNP.

A variety of delivery methods can be used to introduce an RNP disclosed herein into a cell. Exemplary delivery methods or vehicles include but are not limited to microinjection, liposomes (see, e.g., U.S. Pat. No. 10,829,787) such as molecular trojan horses liposomes that delivers molecules across the blood brain barrier (see, Pardridge et al. (2010) COLD SPRING HARB. PROTOC., doi: 10.1101/pdb.prot5407), immunoliposomes, virosomes, microvesicles (e.g., exosomes and ARMMs), polycations, lipid: nucleic acid conjugates, electroporation, cell permeable peptides (see, U.S. Pat. No. 11,118,194), nanoparticles, nanowires (see, Shalek et al. (2012) NANO LETTERS, 12:6498), exosomes, and perturbation of cell membrane (e.g., by passing cells through a constriction in a microfluidic system, see, U.S. Pat. No. 11,125,739). In certain embodiments the delivery method is electroporation. Where the target cell is a proliferating cell, the efficiency of RNP delivery can be enhanced by cell cycle synchronization (see, U.S. Pat. No. 10,570,418).

In other embodiments, the modified guide CRISPR-CAS system, e.g., modified dual guide CRISPR-Cas system is delivered into a cell in a "Cas RNA" approach, i.e., delivering a targeter nucleic acid, a modulator nucleic acid, where the 5' and/or 3' ends of one or both of the targeter and modulator nucleic acids contain one or more, e.g., 1-5 or more than 5, such as 1, 2, 3, 4, 5, or more than 5 modified nucleotides, and an RNA (e.g., messenger RNA (mRNA)) encoding a Cas protein. The RNA encoding the Cas protein can be translated in the cell and form a complex with the targeter nucleic acid and the modulator nucleic acid intracellularly. Similar to the RNP approach, RNAs have limited half-lives in cells, even though stability-increasing modification(s) can be made in one or more of the RNAs. Accordingly, the "Cas RNA" approach is suitable for active modification of the genetic or epigenetic information in a cell during a limited time period, such as DNA cleavage, and has the advantage of reducing off-targeting.

The mRNA can be produced by transcription of a DNA comprising a regulatory element operably linked to a Cas coding sequence. Given that multiple copies of Cas protein can be generated from one mRNA, the targeter nucleic acid and the modulator nucleic acid are generally provided in excess molar amount (e.g., at least 5 fold, at least 10 fold, at least 20 fold, at least 30 fold, at least 50 fold, or at least 100 fold) relative to the mRNA. In certain embodiments, the targeter nucleic acid and the modulator nucleic acid are annealed under suitable conditions prior to delivery into the cells. In other embodiments, the targeter nucleic acid and the modulator nucleic acid are delivered into the cells without annealing in vitro. In certain embodiments, a modified dual guide nucleic acid system is used. In certain embodiments, a modified single guide nucleic acid system is used.

A variety of delivery systems can be used to introduce an "Cas RNA" system into a cell. Non-limiting examples of delivery methods or vehicles include microinjection, biolistic particles, liposomes (see, e.g., U.S. Pat. No. 10,829,787) such as molecular trojan horses liposomes that delivers molecules across the blood brain barrier (see, Pardridge et al. (2010) COLD SPRING HARB. PROTOC., doi: 10.1101/pdb-.prot5407), immunoliposomes, virosomes, polycations, lipid: nucleic acid conjugates, electroporation, nanoparticles, nanowires (see, Shalek et al. (2012) NANO LETTERS, 12:6498), exosomes, and perturbation of cell membrane (e.g., by passing cells through a constriction in a microfluidic system, see, U.S. Pat. No. 11,125,739). Specific examples of the "nucleic acid only" approach by electroporation are described in International (PCT) Publication No. WO2016/164356.

In other embodiments, the modified guide CRISPR-Cas system, e.g., modified dual guide CRISPR-Cas system is delivered into a cell in the form of a targeter nucleic acid, a modulator nucleic acid, where the 5' and/or 3' ends of one or both of the targeter and modulator nucleic acids contain one or more, e.g., 1-5 or more than 5, such as 1, 2, 3, 4, 5, or more than 5 modified nucleotides, and a DNA comprising a regulatory element operably linked to a Cas coding sequence. The DNA can be provided in a plasmid, viral vector, or any other form described in the "CRISPR Expression Systems" subsection. Such delivery method may result in constitutive expression of Cas protein in the target cell (e.g., if the DNA is maintained in the cell in an episomal vector or is integrated into the genome), and may increase the risk of off-targeting which is undesirable when the Cas protein has nuclease activity. Notwithstanding, this approach is useful when the Cas protein comprises a non-nuclease effector (e.g., a transcriptional activator or repressor). It is also useful for research purposes and for genome editing of plants.

B. CRISPR Expression Systems

In another aspect, the present invention provides a CRISPR expression system comprising: either (a) a nucleic acid comprising a first regulatory element operably linked to a nucleotide sequence encoding a targeter nucleic acid disclosed herein comprising (i) a spacer sequence designed to hybridize with a target nucleotide sequence and (ii) a targeter stem sequence; or (b) a nucleic acid comprising a second regulatory element operably linked to a nucleotide sequence encoding a modulator nucleic acid disclosed herein comprising a modulator stem sequence complementary to the targeter stem sequence, wherein a complex comprising the targeter nucleic acid and a modified modulator nucleic acid, as described herein, or a complex comprising a modified targeter nucleic acid, as described herein, and the modulator nucleic acid is capable of activating a Cas nuclease that, in a naturally occurring system, is activated by a single crRNA in the absence of a tracrRNA. Exemplary targeter and modulator nucleic acids are described in sections IA, IA1, and 1B.

In certain embodiments, the CRISPR expression system further comprises (c) a nucleic acid comprising a third regulatory element operably linked to a nucleotide sequence encoding a Cas protein disclosed herein. In certain embodiments, the Cas protein comprises an amino acid sequence at least 80% (e.g., at least 85%, at least 90%, at least 91%, at least 92%, at least 93%, at least 94%, at least 95%, at least 96%, at least 97%, at least 98%, or at least 99%) identical to the Cas nuclease, thereby resulting in modification of the target nucleic acid (e.g., DNA). In certain embodiments, the Cas protein and the Cas nuclease are identical, and the method results in cleavage of the target nucleic acid. In certain embodiments, the Cas nuclease is a Type I, II, III, IV, V, or VI nuclease. In certain embodiments the Cas nuclease is a Type V nuclease. In certain embodiments, the Cas nuclease is a type V-A, type V-C, or type V-D Cas nuclease. In certain embodiments, the Cas nuclease is a type V-A Cas nuclease. Exemplary Cas Nucleases are described in section IC.

As used in this context, the term "operably linked" is intended to mean that the nucleotide sequence of interest is linked to the regulatory element in a manner that allows for expression of the nucleotide sequence (e.g., in an in vitro transcription/translation system or in a host cell when the vector is introduced into the host cell).

The form of elements (a), (b), and (c) of the CRISPR expression system described above may be independently selected from various nucleic acids such as DNA (e.g., modified DNA) and RNA (e.g., modified RNA). In certain embodiments, elements (a) and (b) are each in the form of DNA. In certain embodiments, the CRISPR expression system further comprises element (c) in the form of DNA. The third regulatory element can be a constitutive or inducible promoter that drives the expression of the Cas protein. In other embodiments, the CRISPR expression system further comprises element (c) in the form of RNA (e.g., mRNA).

Elements (a), (b), and/or (c) can be provided in one or more vectors. The term "vector," as used herein, can include a nucleic acid molecule capable of transporting another nucleic acid to which it has been linked. Conventional viral and non-viral based gene transfer methods can be used to introduce nucleic acids in cells, such as prokaryotic cells, eukaryotic cells, mammalian cells, or target tissues. Non-viral vector delivery systems include DNA plasmids, RNA (e.g., a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. Gene therapy procedures are known in the art and disclosed in Van Brunt (1988) BIOTECHNOLOGY, 6:1149; Anderson (1992) SCIENCE, 256:808; Nabel & Feigner (1993) TIBTECH, 11:211; Mitani & Caskey (1993) TIBTECH, 11:162; Dillon (1993) TIBTECH, 11:167; Miller (1992) NATURE, 357:455; Vigne, (1995) RESTORATIVE NEUROLOGY AND NEUROSCIENCE, 8:35; Kremer & Perricaudet (1995) BRITISH MEDICAL BULLETIN, 51:31; Haddada et al. (1995) CURRENT TOPICS IN MICROBIOLOGY AND IMMUNOLOGY, 199:297; Yu et al. (1994) GENE THERAPY, 1:13; and Doerfler and Bohm (Eds.) (2012) The Molecular Repertoire of Adenoviruses II: Molecular Biology of Virus-Cell Interactions. In certain embodiments, at least one of the vectors is a DNA plasmid. In certain embodiments, at least one of the vectors is a viral vector (e.g., retrovirus, adenovirus, or adeno-associated virus).

Certain vectors are capable of autonomous replication in a host cell into which they are introduced (e.g., bacterial vectors having a bacterial origin of replication and episomal mammalian vectors). Other vectors (e.g., non-episomal mammalian vectors and replication defective viral vectors) do not autonomously replicate in the host cell. Certain vectors, however, may be integrated into the genome of the host cell and thereby are replicated along with the host genome. A skilled person in the art will appreciate that different vectors may be suitable for different delivery methods and have different host tropism, and will be able to select one or more vectors suitable for the use.

The term "regulatory element," as used herein, can include a transcriptional and/or translational control sequence, such as a promoter, enhancer, transcription termination signal (e.g., polyadenylation signal), internal ribosomal entry sites (IRES), protein degradation signal, and the like, that provide for and/or regulate transcription of a non-coding sequence (e.g., a targeter nucleic acid or a modulator nucleic acid) or a coding sequence (e.g., a Cas protein) and/or regulate translation of an encoded polypeptide. Such regulatory elements are described, for example, in Goeddel, GENE EXPRESSION TECHNOLOGY: METHODS IN ENZYMOLOGY, 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In certain embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer), the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (see, Takebe et al. (1988) MOL. CELL. BIOL., 8:466); SV40 enhancer; and the intron sequence between exons 2 and 3 of rabbit β-globin (see, O'Hare et al. (1981) PROC. NATL. ACAD. SCI. USA., 78:1527). It will be appreciated by those skilled in the art that the design of the expression vector can depend on factors such as the choice of the host cell to be transformed, the level of expression desired, etc. A vector can be introduced into host cells to produce transcripts, proteins, or peptides, including fusion proteins or peptides, encoded by nucleic acids as described herein (e.g., CRISPR transcripts, proteins, enzymes, mutant forms thereof, or fusion proteins thereof).

In certain embodiments, the nucleotide sequence encoding the Cas protein is codon optimized for expression in a eukaryotic host cell, e.g., a yeast cell, a mammalian cell (e.g., a mouse cell, a rat cell, or a human cell), or a plant cell. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.or.jp/codon/ and these tables can be adapted in a number of ways (see, Nakamura et al. (2000) NUCL. ACIDS RES., 28:292). Computer algorithms for codon optimizing a particular sequence for expression in a particular host cell, such as Gene Forge (Aptagen; Jacobus, Pa.), are also available. In certain embodiments, the codon optimization facilitates or improves expression of the Cas protein in the host cell.

C. Donor Templates

Cleavage of a target nucleotide sequence in the genome of a cell by the modified dual guide CRISPR-Cas system or complex disclosed herein can activate the DNA damage pathways, which may rejoin the cleaved DNA fragments by NHEJ or HDR. HDR requires a repair template, either endogenous or exogenous, to transfer the sequence information from the repair template to the target.

In certain embodiments, the engineered, non-naturally occurring system or CRISPR expression system further comprises a donor template. As used herein, the term "donor template" can include a nucleic acid designed to serve as a repair template at or near the target nucleotide sequence upon introduction into a cell or organism. In certain embodiments, the donor template is complementary to a polynucleotide comprising the target nucleotide sequence or a portion thereof. When optimally aligned, a donor template may overlap with one or more nucleotides of a target nucleotide sequences (e.g., at least 1, 5, 10, 15, 20, 25, 30, 35, 40, 50, 100, 500 or more nucleotides). The nucleotide sequence of the donor template is typically not identical to the genomic sequence that it replaces. Rather, the donor template may contain one or more substitutions, insertions, deletions, inversions or rearrangements with respect to the genomic sequence, so long as sufficient homology is present to support homology-directed repair. In certain embodiments, the donor template comprises a non-homologous sequence flanked by two regions of homology (i.e., homology arms), such that homology-directed repair between the target DNA region and the two flanking sequences results in insertion of the non-homologous sequence at the target region. In certain embodiments, the donor template comprises a non-homologous sequence of 10-100 nucleotides, 50-500 nucleotides, 100-1,000 nucleotides, 200-2,000 nucleotides, or 500-5,000 nucleotides in length positioned between two homology arms. In certain embodiments the donor template comprises a single stranded oligodeoxynucleotide (ssODN).

Generally, the homologous region(s) of a donor template has at least 50% sequence identity to a genomic sequence with which recombination is desired. The homology arms are designed or selected such that they are capable of recombining with the nucleotide sequences flanking the target nucleotide sequence under intracellular conditions. In certain embodiments, where HDR of the non-target strand is desired, the donor template comprises a first homology arm homologous to a sequence 5' to the target nucleotide sequence and a second homology arm homologous to a sequence 3' to the target nucleotide sequence. In certain embodiments, the first homology arm is at least 50% (e.g., at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100%) identical to a sequence 5' to the target nucleotide sequence. In certain embodiments, the second homology arm is at least 50% (e.g., at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100%) identical to a sequence 3' to the target nucleotide sequence. In certain embodiments, when the donor template sequence and a polynucleotide comprising a target nucleotide sequence are optimally aligned, the nearest nucleotide of the donor template is within at least 5, 10, 15, 20, 25, 50, 75, 100, 200, 300, 400, 500, 1000, 2000, 3000, 4000, or more nucleotides from the target nucleotide sequence.

In certain embodiments, the donor template further comprises an engineered sequence not homologous to the sequence to be repaired. Such engineered sequence can harbor a barcode and/or a sequence capable of hybridizing with a donor template-recruiting sequence disclosed herein.

In certain embodiments, the donor template further comprises one or more mutations relative to the genomic sequence, wherein the one or more mutations reduce or prevent cleavage, by the same CRISPR-Cas system, of the donor template or of a modified genomic sequence with at least a portion of the donor template sequence incorporated. In certain embodiments, in the donor template, the PAM adjacent to the target nucleotide sequence and recognized by the Cas nuclease is mutated to a sequence not recognized by the same Cas nuclease. In certain embodiments, in the donor template, the target nucleotide sequence (e.g., the seed region) is mutated. In certain embodiments, the one or more mutations are silent with respect to the reading frame of a protein-coding sequence encompassing the mutated sites.

The donor template can be provided to the cell as single-stranded DNA, single-stranded RNA, double-stranded DNA, or double-stranded RNA. It is understood that the modified dual guide CRISPR-Cas system disclosed herein may possess nuclease activity to cleave the target strand, the non-target strand, or both. When HDR of the target strand is desired, a donor template having a nucleic acid sequence complementary to the target strand is also contemplated.

The donor template can be introduced into a cell in linear or circular form. If introduced in linear form, the ends of the donor template may be protected (e.g., from exonucleolytic degradation) by methods known to those of skill in the art. For example, one or more dideoxynucleotide residues are added to the 3' terminus of a linear molecule and/or self-complementary oligonucleotides are ligated to one or both ends (see, for example, Chang et al. (1987) PROC. NATL. ACAD SCI USA, 84:4959; Nehls et al. (1996) SCIENCE, 272:886; see also the chemical modifications for increasing stability and/or specificity of RNA disclosed supra). Additional methods for protecting exogenous polynucleotides from degradation include, but are not limited to, addition of terminal amino group(s) and the use of modified nucleotides such as, for example, phosphorothioates, phosphoramidates, and O-methyl ribose or deoxyribose residues. As an alternative to protecting the termini of a linear donor template, additional lengths of sequence may be included outside of the regions of homology that can be degraded without impacting recombination.

A donor template can be a component of a vector as described herein, contained in a separate vector, or provided as a separate polynucleotide, such as an oligonucleotide, linear polynucleotide, or synthetic polynucleotide. In certain embodiments, the donor template is a DNA. In certain embodiments, a donor template is in the same nucleic acid as a sequence encoding the targeter nucleic acid, a sequence encoding the modulator nucleic acid, and/or a sequence encoding the Cas protein, where applicable. In certain embodiments, a donor template is provided in a separate nucleic acid. A donor template polynucleotide may be of any suitable length, such as at least 50, 75, 100, 150, 200, 500, 1000, 2000, 3000, 4000, or more nucleotides in length, for example 50 to 500 nucleotides in length, such as 500 nucleotides in length.

A donor template can be introduced into a cell as an isolated nucleic acid. Alternatively, a donor template can be introduced into a cell as part of a vector (e.g., a plasmid) having additional sequences such as, for example, replication origins, promoters and genes encoding antibiotic resistance, that are not intended for insertion into the DNA region of interest. Alternatively, a donor template can be delivered by viruses (e.g., adenovirus, adeno-associated virus (AAV)). In certain embodiments, the donor template is introduced as an AAV, e.g., a pseudotyped AAV. The capsid proteins of the AAV can be selected by a person skilled in the art based upon the tropism of the AAV and the target cell type. For example, in certain embodiments, the donor template is introduced into a hepatocyte as AAV8 or AAV9. In certain embodiments, the donor template is introduced into a hematopoietic stem cell, a hematopoietic progenitor cell, or a T lymphocyte (e.g., CD8+T lymphocyte) as AAV6 or an AAVHSC (see, U.S. Pat. No. 9,890,396). It is understood that the sequence of a capsid protein (VP1, VP2, or VP3) may be modified from a wild-type AAV capsid protein, for example, having at least 50% (e.g., at least 60%, at least 70%, at least 75%, at least 80%, at least 85%, at least 90%, at least 91%, at least 92%, at least 93%, at least 94%, at least 95%, at least 96%, at least 97%, at least 98%, or at least 99%) sequence identity to a wild-type AAV capsid sequence.

The donor template can be delivered to a cell (e.g., a primary cell) by various delivery methods, such as a viral or non-viral method disclosed herein. In certain embodiments, a non-viral donor template is introduced into the target cell as a naked nucleic acid or in complex with a liposome or poloxamer. In certain embodiments, a non-viral donor template is introduced into the target cell by electroporation. In other embodiments, a viral donor template is introduced into the target cell by infection. The engineered, non-naturally occurring system can be delivered before, after, or simultaneously with the donor template (see, International (PCT) Application Publication No. WO2017/053729). A skilled person in the art can choose proper timing based upon the form of delivery (consider, for example, the time needed for transcription and translation of RNA and protein components) and the half-life of the molecule(s) in the cell. In particular embodiments, where the modified guide CRISPR-Cas system, e.g., modified dual guide CRISPR-Cas system including the Cas protein is delivered by electroporation (e.g., as an RNP), the donor template (e.g., as an AAV) is introduced into the cell within 4 hours (e.g., within 1, 2, 3, 4, 5, 6, 7, 8, 9, 10, 11, 12, 13, 14, 15, 16, 17, 18, 19, 20, 25, 30, 35, 40, 45, 50, 55, 60, 90, 120, 150, 180, 210, or 240 minutes) after the introduction of the engineered, non-naturally occurring system.

In certain embodiments, the donor template is conjugated covalently to the modulator nucleic acid. Covalent linkages suitable for this conjugation are known in the art and are described, for example, in U.S. Pat. No. 9,982,278 and Savic et al. (2018) ELIFE 7: e33761. In certain embodiments, the donor template is covalently linked to the modulator nucleic acid (e.g., the 5' end of the modulator nucleic acid) through an internucleotide bond. In certain embodiments, the donor template is covalently linked to the modulator nucleic acid (e.g., the 5' end of the modulator nucleic acid) through a linker.

In certain embodiments, the donor template contains an exogenous gene, e.g., CAR cassette, that is integrated at a targeted site in a host cell, e.g., an immune cell, e.g., a T cell, mediated through the action of a nucleic acid-guided nuclease complex, that results in a modified host cell, e.g., a CAR-T cell.

D. Efficiency and Specificity

The engineered, non-naturally occurring system of the present invention can have the advantage that the efficiency of nucleic acid targeting, cleavage, or modification can be increased or decreased by, for example, adjusting the hybridization of modified guide nucleic acids, e.g., modified dual guide nucleic acids, and the length of the spacer sequence.

In certain embodiments, the engineered, non-naturally occurring system has high efficiency. For example, in certain embodiments, at least 10%, at least 20%, at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% of a population of nucleic acids having the target nucleotide sequence and a cognate PAM, when contacted with the engineered, non-naturally occurring system, is targeted, cleaved, or modified. In certain embodiments, the genomes of at least 10%, at least 20%, at least 30%, at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% of a population of cells, when contacted with the engineered, non-naturally occurring system, are targeted, cleaved, or modified.

It has been observed that the occurrence of on-target events and the occurrence of off-target events are generally correlated. For certain therapeutic purposes, low on-target efficiency can be tolerated and low off-target frequency is more desirable. For example, when editing or modifying a proliferating cell that will be delivered to a subject and proliferate in vivo, tolerance to off-target events is low. Prior to delivery, however, it is possible to assess the on-target and off-target events, thereby selecting one or more colonies that have the desired edit or modification and lack any undesired edit or modification.

The method disclosed herein is suitable for such use. In certain embodiments, when a population of nucleic acids having the target nucleotide sequence and a cognate PAM is contacted with the engineered, non-naturally occurring system disclosed herein, the frequency of off-target events (e.g., targeting, cleavage, or modification, depending on the function of the CRISPR-Cas system) is reduced by at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99% relative to the frequency of off-target events when using the corresponding CRISPR system containing an unmodified guide nucleic acid, e.g., a guide nucleic acid consisting of the sequences of the targeter and modulator nucleic acids, but without modified nucleotides or internucleotide linkages under the same conditions. In certain cases, the frequency is relative to the frequency of off-target events when using the corresponding CRISPR system containing a single guide nucleic acid (e.g., a single crRNA consisting of the sequences of the targeter and modulator nucleic acids) under the same conditions. In certain embodiments, when genomic DNA having the target nucleotide sequence and a cognate PAM is contacted with the engineered, non-naturally occurring system disclosed herein in a population of cells, the frequency of off-target events (e.g., targeting, cleavage, or modification, depending on the function of the CRISPR-Cas system) is reduced by at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99 % relative to the frequency of off-target events when using the corresponding CRISPR system containing an unmodified guide nucleic acid, e.g., a guide nucleic acid consisting of the sequences of the targeter and modulator nucleic acids, but without modified nucleotides or internucleotide linkages under the same conditions. In certain cases, the frequency is relative to the frequency of off-target events when using the corresponding CRISPR system containing a single guide nucleic acid (e.g., a single crRNA consisting of the sequences of the targeter and modulator nucleic acids) under the same conditions. In certain embodiments, when delivered into a population of cells comprising genomic DNA having the target nucleotide sequence and a cognate PAM, the frequency of off-target events (e.g., targeting, cleavage, or modification, depending on the function of the CRISPR-Cas system) in the cells receiving the engineered, non-naturally occurring system disclosed herein is reduced by at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99 % relative to the frequency of off-target events when using the corresponding CRISPR system containing an unmodified guide nucleic acid, e.g., a guide nucleic acid consisting of the sequences of the targeter and modulator nucleic acids, but without modified nucleotides or internucleotide linkages under the same conditions. In certain cases, the frequency is relative to the frequency of off-target events when using the corresponding CRISPR system containing a single guide nucleic acid (e.g., a single crRNA consisting of the sequences of the targeter and modulator nucleic acids) under the same conditions. Methods of assessing off-target events were summarized in Lazzarotto et al. (2018) Nat Protoc. 13 (11): 2615-42, and include discovery of in situ Cas off-targets and verification by sequencing (DISCOVER-seq) as disclosed in Wienert et al. (2019) Science 364 (6437): 286-89; genome-wide unbiased identification of double-stranded breaks (DSBs) enabled by sequencing (GUIDE-seq) as disclosed in Kleinstiver et al. (2016) Nat. Biotech. 34:869-74; circularization for in vitro reporting of cleavage effects by sequencing (CIRCLE-seq) as described in Kocak et al. (2019) Nat. Biotech. 37:657-66. In certain embodiments, the off-target events include targeting, cleavage, or modification at a given off-target locus (e.g., the locus with the highest occurrence of off-target events detected). In certain embodiments, the off-target events include targeting, cleavage, or modification at all the loci with detectable off-target events, collectively.

E. Multiplex Methods

The methods of targeting, editing, and/or modifying a genomic DNA disclosed herein can be conducted in multiplicity. For example, a library of targeter nucleic acids can be used to target multiple genomic loci; a library of donor templates can also be used to generate multiple insertions, deletions, and/or substitutions. The multiplex assay can be conducted in a screening method wherein each separate cell culture (e.g., in a well of a 96-well plate or a 384-well plate) is exposed to a different targeter nucleic acid or a different combination of targeter nucleic acid and donor template. The multiplex assay can also be conducted in a selection method wherein a cell culture is exposed to a mixed population of different targeter nucleic acids and/or donor templates, and the cells with desired characteristics (e.g., functionality) are enriched or selected by advantageous survival or growth, resistance to a certain agent, expression of a detectable protein (e.g., a fluorescent protein that is detectable by flow cytometry), etc.

In certain embodiments, the multiplex method employs a plurality of targeter nucleic acids that are capable of hybridizing with different target nucleotide sequences. In certain embodiments, the plurality of targeter nucleic acids comprise a common targeter stem sequence. In certain embodiments, the multiplex method employs a single modulator nucleic acid capable of hybridizing with the plurality of targeter nucleic acids. In certain embodiments, the multiplex method employs a single Cas protein (e.g., Cas nuclease) disclosed herein.

In certain embodiments, the multiplex method employs a plurality of targeter nucleic acids that are capable of hybridizing with different target nucleotide sequences that are close to or adjacent to different PAMs. In certain embodiments, the plurality of targeter nucleic acids comprise different targeter stem sequences. In certain embodiments, the multiplex method employs a plurality of modulator nucleic acids each capable of hybridizing with a different targeter nucleic acid. In certain embodiments, the multiplex method employs a plurality of Cas proteins (e.g., Cas nucleases) disclosed herein that have different PAM specificity.

In certain embodiments, the multiplex method further comprises introducing one or more donor templates into the population of cells. In certain embodiments, the multiplex method employs a plurality of modulator nucleic acids each comprising a different donor template-recruiting sequence, wherein each donor template-recruiting sequence is capable of hybridizing with a different donor template.

In certain embodiments, the plurality of targeter nucleic acids and/or the plurality of donor templates are designed for saturation editing. For example, in certain embodiments, each nucleotide position in a sequence of interest is systematically modified with each of all four traditional bases, A, T, G and C. In other embodiments, at least one sequence in each gene from a pool of genes of interest is modified, for example, according to a CRISPR design algorithm. In certain embodiments, each sequence from a pool of exogenous elements of interest (e.g., protein coding sequences, non-protein coding genes, regulatory elements) is inserted into one or more given loci of the genome.

It is understood that the multiplex methods suitable for the purpose of carrying out a screening or selection method, which is typically conducted for research purposes, may be different from the methods suitable for therapeutic purposes. For example, constitutive expression of certain elements (e.g., a Cas nuclease and/or a modulator nucleic acid) may be undesirable for therapeutic purposes due to the potential of increased off-targeting. Conversely, for research purposes, constitutive expression of a Cas nuclease and/or a modulator nucleic acid may be desirable. For example, the constitutive expression provides a large window during which other elements can be introduced. When a stable cell line is established for the constitutive expression, the number of exogenous elements that need to be co-delivered into a single cell is also reduced. Therefore, constitutive expression of certain elements can increase the efficiency and reduce the complexity of a screening or selection process. Inducible expression of certain elements of the system disclosed herein may also be used for research purposes given similar advantages. Expression may be induced by an exogenous agent (e.g., a small molecule) or by an endogenous molecule or complex present in a particular cell type (e.g., at a particular stage of differentiation). Methods known in the art, such as those described in the "CRISPR Expression Systems" subsection supra, can be used for constitutively or inducibly expressing one or more elements.

It is further understood that despite the need to introduce at least three elements—the targeter nucleic acid, the modulator nucleic acid, and the Cas protein—these three elements can be delivered into the cell as a single complex of pre-formed RNP. Therefore, the efficiency of the screening or selection process can also be achieved by pre-assembling a plurality of RNP complexes in a multiplex manner.

In certain embodiments, the method disclosed herein further comprises a step of identifying a targeter nucleic acid, a modulator nucleic acid, a Cas protein, a donor template, or a combination of two or more of these elements from the screening or selection process. A set of barcodes may be used, for example, in the donor template between two homology arms, to facilitate the identification. In specific embodiments, the method further comprises harvesting the population of cells; selectively amplifying a genomic DNA or RNA sample including the target nucleotide sequence(s) and/or the barcodes; and/or sequencing the genomic DNA or RNA sample and/or the barcodes that has been selectively amplified.

In another aspect, the present invention provides a library comprising a plurality of targeter nucleic acids disclosed herein, optionally further comprising one or more modulator nucleic acids disclosed herein. In another aspect, the present invention provides a library comprising a plurality of nucleic acids each comprising a regulatory element operably linked to a different targeter nucleic acid disclosed herein, optionally further comprising a regulatory element operably linked to a modulator nucleic acid disclosed herein. These libraries can be used in combination with one or more Cas proteins or Cas-coding nucleic acids disclosed herein, and/or one or more donor templates as disclosed herein for a screening or selection method.

III. PHARMACEUTICAL COMPOSITIONS

The present invention provides a composition (e.g., pharmaceutical composition) comprising an engineered, non-naturally occurring system or a eukaryotic cell disclosed herein. In certain embodiments, the composition comprises a complex of the targeter nucleic acid and the modulator nucleic acid. In certain embodiments, the composition comprises an RNP comprising the targeter nucleic acid, the modulator nucleic acid, and a Cas protein (e.g., the Cas nuclease that the targeter nucleic acid and the modulator nucleic acid are capable of activating or a related Cas protein). Targeter and modulator nucleic acids, and modifications thereto, are described in sections IA, IA1, and IB; Cas proteins, e.g., Cas nucleases, are described in section IC; RNPs are described in section IIA.

In addition, the present invention provides a method of producing a composition, the method comprising incubating the targeter nucleic acid and the modulator nucleic acid of an engineered, non-naturally occurring system disclosed herein under suitable conditions, thereby producing a composition (e.g., pharmaceutical composition) comprising a complex of the targeter nucleic acid and the modulator nucleic acid. In certain embodiments, the method further comprises incubating the targeter nucleic acid and the modulator nucleic acid with a Cas protein (e.g., the Cas nuclease that the targeter nucleic acid and the modulator nucleic acid are capable of activating or a related Cas protein), thereby producing a complex of the targeter nucleic acid, the modulator nucleic acid, and the Cas protein (e.g., an RNP). In certain embodiments, the method further comprises purifying the complex (e.g., the RNP).

For therapeutic use, an engineered, non-naturally occurring system, a CRISPR expression system, or a cell comprising such system or modified by such system disclosed herein is combined with a pharmaceutically acceptable carrier. The term "pharmaceutically acceptable" as used herein can include those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit-to-risk ratio.

The term "pharmaceutically acceptable carrier" as used herein can include buffers, carriers, and excipients suitable for use in contact with the tissues of human beings and animals without excessive toxicity, irritation, allergic response, or other problem or complication, commensurate with a reasonable benefit/risk ratio. Pharmaceutically acceptable carriers include any of the standard pharmaceutical carriers, such as a phosphate buffered saline solution, water, emulsions (e.g., such as an oil/water or water/oil emulsions), and various types of wetting agents. The compositions also can include stabilizers and preservatives. For examples of carriers, stabilizers and adjuvants, see, e.g., Martin, Remington's Pharmaceutical Sciences, 15th Ed., Mack Publ. Co., Easton, PA (1975). Pharmaceutically acceptable carriers include buffers, solvents, dispersion media, coatings, isotonic and absorption delaying agents, and the like, that are compatible with pharmaceutical administration. The use of such media and agents for pharmaceutically active substances is known in the art.

In certain embodiments, a pharmaceutical composition disclosed herein comprises a salt, e.g., NaCl, $MgCl_2$, KCl, $MgSO_4$, etc.; a buffering agent, e.g., a Tris buffer, N-(2-Hydroxyethyl) piperazine-N'-(2-ethanesulfonic acid) (HEPES), 2-(N-Morpholino) ethanesulfonic acid (MES), MES sodium salt, 3-(N-Morpholino) propanesulfonic acid (MOPS), N-tris [Hydroxymethyl]methyl-3-aminopropanesulfonic acid (TAPS), etc.; a solubilizing agent; a detergent, e.g., a non-ionic detergent such as Tween-20, etc.; a nuclease inhibitor; and the like. For example, in certain embodiments, a subject composition comprises a subject DNA-targeting RNA and a buffer for stabilizing nucleic acids.

In certain embodiments, a pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants (see, *Remington's Pharmaceutical Sciences,* 18th ed. (Mack Publishing Company, 1990).

In certain embodiments, a pharmaceutical composition may contain nanoparticles, e.g., polymeric nanoparticles, liposomes, or micelles (See Anselmo et al. (2016) BIOENG. TRANSL. MED. 1:10-29). In certain embodiment, the pharmaceutical composition comprises an inorganic nanoparticle. Exemplary inorganic nanoparticles include, e.g., magnetic nanoparticles (e.g., $Fe_3MnO_2$) or silica. The outer surface of the nanoparticle can be conjugated with a positively charged polymer (e.g., polyethylenimine, polylysine, polyserine) which allows for attachment (e.g., conjugation or entrapment) of payload. In certain embodiment, the pharmaceutical composition comprises an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating. In certain embodiment, the pharmaceutical composition comprises a liposome, for example, a liposome disclosed in International (PCT) Publication No. WO2015/148863.

In certain embodiments, the pharmaceutical composition comprises a targeting moiety to increase target cell binding or update of nanoparticles and liposomes. Exemplary targeting moieties include cell specific antigens, monoclonal antibodies, single chain antibodies, aptamers, polymers, sugars, and cell penetrating peptides. In certain embodiments, the pharmaceutical composition comprises a fusogenic or endosome-destabilizing peptide or polymer.

In certain embodiments, a pharmaceutical composition may contain a sustained- or controlled-delivery formulation. Techniques for formulating sustained- or controlled-delivery means, such as liposome carriers, bio-erodible microparticles or porous beads and depot injections, are also known to those skilled in the art. Sustained-release preparations may include, e.g., porous polymeric microparticles or semipermeable polymer matrices in the form of shaped articles, e.g., films, or microcapsules. Sustained release matrices may include polyesters, hydrogels, polylactides, copolymers of L-glutamic acid and gamma ethyl-L-glutamate, poly (2-hydroxyethyl-inethacrylate), ethylene vinyl acetate, or poly-D (−)-3-hydroxybutyric acid. Sustained release compositions may also include liposomes that can be prepared by any of several methods known in the art.

A pharmaceutical composition of the invention can be administered by a variety of methods known in the art. The route and/or mode of administration vary depending upon the desired results. Administration can be intravenous, intramuscular, intraperitoneal, or subcutaneous, or administered proximal to the site of the target. The pharmaceutically acceptable carrier should be suitable for intravenous, intramuscular, subcutaneous, parenteral, spinal or epidermal administration (e.g., by injection or infusion). Depending on the route of administration, the active compound, i.e., the multispecific antibody of the invention, may be coated in a material to protect the compound from the action of acids and other natural conditions that may inactivate the compound.

Formulation components suitable for parenteral administration include a sterile diluent such as water for injection, saline solution, fixed oils, polyethylene glycols, glycerin, propylene glycol or other synthetic solvents; antibacterial agents such as benzyl alcohol or methyl parabens; antioxidants such as ascorbic acid or sodium bisulfite; chelating agents such as EDTA; buffers such as acetates, citrates or phosphates; and agents for the adjustment of tonicity such as sodium chloride or dextrose.

For intravenous administration, suitable carriers include physiological saline, bacteriostatic water, Cremophor ELTM (BASF, Parsippany, NJ) or phosphate buffered saline (PBS). The carrier should be stable under the conditions of manufacture and storage, and should be preserved against microorganisms. The carrier can be a solvent or dispersion medium containing, for example, water, ethanol, polyol (for example, glycerol, propylene glycol, and liquid polyethylene glycol), and suitable mixtures thereof.

Pharmaceutical formulations preferably are sterile. Sterilization can be accomplished by any suitable method, e.g., filtration through sterile filtration membranes. Where the composition is lyophilized, filter sterilization can be conducted prior to or following lyophilization and reconstitution. In certain embodiments, a multispecific antibody is lyophilized, and then reconstituted in buffered saline, at the time of administration.

Pharmaceutical compositions of the invention can be prepared in accordance with methods well known and routinely practiced in the art. See, e.g., Remington: The Science and Practice of Pharmacy, Mack Publishing Co., 20th ed., 2000; and Sustained and Controlled Release Drug Delivery Systems, J. R. Robinson, ed., Marcel Dekker, Inc., New York, 1978. Pharmaceutical compositions are preferably manufactured under GMP conditions. Typically, a therapeutically effective dose or efficacious dose of the multispecific antibody of the invention is employed in the pharmaceutical compositions of the invention. The multispecific antibodies of the invention are formulated into pharmaceutically acceptable dosage forms by conventional methods known to those of skill in the art. Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

Actual dosage levels of the active ingredients in the pharmaceutical compositions of the invention can be varied so as to obtain an amount of the active ingredient which is effective to achieve the desired therapeutic response for a particular patient, composition, and mode of administration, without being toxic to the patient. The selected dosage level depends upon a variety of pharmacokinetic factors including the activity of the particular compositions of the present invention employed, or the ester, salt or amide thereof, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors.

IV. THERAPEUTIC USES

The engineered, non-naturally occurring system and CRISPR expression system disclosed herein are useful for targeting, editing, and/or modifying the genomic DNA in a cell or organism. These systems, as well as a cell comprising one of the systems or a cell whose genome has been modified by the engineered, non-naturally occurring system, can be used to treat a disease or disorder in which modification of genetic or epigenetic information is desirable. Accordingly, in another aspect, the present invention provides a method of treating a disease or disorder, the method comprising administering to a subject in need thereof an effective amount of a non-naturally occurring system, a CRISPR expression system, or a cell disclosed herein.

The term "subject" can include human and non-human animals. Non-human animals include all vertebrates, e.g., mammals and non-mammals, such as non-human primates, sheep, dog, cow, chickens, amphibians, and reptiles. Except when noted, the terms "patient" or "subject" are used herein interchangeably.

The terms "treatment", "treating", "treat", "treated", and the like, as used herein, can include obtaining a desired pharmacologic and/or physiologic effect. The effect may be therapeutic in terms of a partial or complete cure for a disease and/or adverse effect attributable to the disease or delaying the disease progression. "Treatment", as used herein, covers any treatment of a disease in a mammal, e.g., in a human, and includes: (a) inhibiting the disease, i.e., arresting its development; and (b) relieving the disease, i.e., causing regression of the disease. It is understood that a disease or disorder may be identified by genetic methods and treated prior to manifestation of any medical symptom.

For therapeutic purposes, the method disclosed herein is particularly suitable for editing or modifying a proliferating cell, such as a stem cell (e.g., a hematopoietic stem cell), a progenitor cell (e.g., a hematopoietic progenitor cell or a lymphoid progenitor cell), or a memory cell (e.g., a memory T cell). Given that such cell is delivered to a subject and will proliferate in vivo, tolerance to off-target events is low. Prior to delivery, however, it is possible to assess the on-target and off-target events, thereby selecting one or more colonies that have the desired edit or modification and lack any undesired edit or modification. Therefore, lower editing or modifying efficiency can be tolerated for such cell. The engineered, non-naturally occurring system of the present invention has the advantage of increasing or decreasing the efficiency of nucleic acid cleavage by, for example, adjusting the hybridization of modified dual guide nucleic acids. As a result, it can be used to minimize off-target events when creating genetically engineered proliferating cells.

For minimization of toxicity and off-target effect, it is important to control the concentration of the modified guide CRISPR-Cas system, e.g., modified dual guide CRISPR-Cas system, delivered. Optimal concentrations can be determined by testing different concentrations in a cellular, tissue, or non-human eukaryote animal model and using deep sequencing to analyze the extent of modification at potential off-target genomic loci. The concentration that gives the highest level of on-target modification while minimizing the level of off-target modification can be selected for ex vivo or in vivo delivery.

B. Gene Therapies

It is understood that the engineered, non-naturally occurring system and CRISPR expression system disclosed herein can be used to treat a genetic disease or disorder, i.e., a disease or disorder associated with or otherwise mediated by an undesirable mutation in the genome of a subject.

Exemplary genetic diseases or disorders include age-related macular degeneration, adrenoleukodystrophy (ALD), Alagille syndrome, alpha-1-antitrypsin deficiency, argininemia, argininosuccinic aciduria, ataxia (e.g., Friedreich ataxia, spinocerebellar ataxias, ataxia telangiectasia, essential tremor, spastic paraplegia), autism, biliary atresia, biotinidase deficiency, carbamoyl phosphate synthetase I deficiency, carbohydrate deficient glycoprotein syndrome (CDGS), a central nervous system (CNS)-related disorder (e.g., Alzheimer's disease, amyotrophic lateral sclerosis (ALS), canavan disease (CD), ischemia, multiple sclerosis (MS), neuropathic pain, Parkinson's disease), Bloom's syndrome, cancer, Charcot-Marie-Tooth disease (e.g., peroneal muscular atrophy, hereditary motor sensory neuropathy), congenital hepatic porphyria, citrullinemia, Crigler-Najjar syndrome, cystic fibrosis (CF), Dentatorubro-Pallidoluysian Atrophy (DRPLA). Diabetes insipidus, Fabry, familial hypercholesterolemia (LDL receptor defect), Fanconi's anemia, fragile X syndrome, a fatty acid oxidation disorder, galactosemia, glucose-6-phosphate dehydrogenase (G6PD), glycogen storage diseases (e.g., type I (glucose-6-phosphatase deficiency, Von Gierke II (alpha glucosidase deficiency, Pompe), III (debrancher enzyme deficiency, Cori), IV (brancher enzyme deficiency, Anderson), V (muscle glycogen phosphorylase deficiency, McArdle), VII (muscle phosphofructokinase deficiency, Tauri), VI (liver phosphorylase deficiency, Hers), IX (liver glycogen phosphorylase kinase deficiency)), hemophilia A (associated with defective factor VIII), hemophilia B (associated with defective factor IX), Huntington's disease, glutaric aciduria, hypophosphatemia, Krabbe, lactic acidosis, Lafora disease, Leber's Congenital Amaurosis, Lesch Nyhan syndrome, a lysosomal storage disease, metachromatic leukodystrophy disease (MLD), mucopolysaccharidosis (MPS) (e.g., Hunter syndrome, Hurler syndrome, Maroteaux-Lamy syndrome, Sanfilippo syndrome, Scheie syndrome, Morquio syndrome, other, MPSI, MPSII, MPSIII, MSIV, MPS 7), a muscular/skeletal disorder (e.g., muscular dystrophy, Duchenne muscular dystrophy), myotonic Dystrophy (DM), neoplasia, N-acetylglutamate synthase deficiency, ornithine transcarbamylase deficiency, phenylketonuria, primary open angle glaucoma, retinitis pigmentosa, schizophrenia, Severe Combined Immune Deficiency (SCID), Spinobulbar Muscular Atrophy (SBMA), sickle cell anemia, Usher syndrome, Tay-Sachs disease, thalassemia (e.g. β-Thalassemia), trinucleotide repeat disorders, tyrosinemia, Wilson's disease, Wiskott-Aldrich syndrome, X-linked chronic granulomatous disease (CGD), X-linked severe combined immune deficiency, and xeroderma pigmentosum.

Genetic Disorders contemplated herein can include, but are not limited to:

- Neoplasia: Genes linked to this disorder: PTEN; ATM; ATR; EGFR; ERBB2; ERBB3; ERBB4; Notchl; Notch2; Notch3; Notch4; AKT; AKT2; AKT3; HIF; HIFI a; HIF3a; Met; HRG; Bc12; PPAR alpha; PPAR gamma; WT1 (Wilms Tumor); FGF Receptor Family members (5 members: 1, 2, 3, 4, 5); CDKN2a; APC; RB (retinoblastoma); MEN1; VHL; BRCA1; BRCA2; AR (Androgen Receptor); TSG101; IGF; IGF Receptor; Igf1 (4 variants); Igf2 (3 variants); Igf 1 Receptor; Igf 2 Receptor; Bax; Bc12; caspases family (9 members: 1, 2, 3, 4, 6, 7, 8, 9, 12); Kras; Apc;
- Age-related Macular Degeneration: Genes linked to these disorders Aber; Cc12; Cc2; cp (cemloplasmin); Timp3; cathepsinD; Vidlr; Ccr2;
- Schizophrenia Disorders: Genes linked to this disorder: Neuregulinl (Nrgl); Erb4 (receptor for Neuregulin); Complexinl (Cp1x1); Tphl Tryptophan hydroxylase; Tph2 Tryptophan hydroxylase 2; Neurexin 1; GSK3; GSK3a; GSK3b;
- Trinucleotide Repeat Disorders: Genes linked to this disorder: 5 HTT (Huntington's Dx); SBMA/SMAX1/AR (Kennedy's Dx); FXN/X25 (Friedrich's Ataxia); ATX3 (Machado-Joseph's Dx); ATXN1 and ATXN2 (spinocerebellar ataxias); DMPK (myotonic dystrophy); Atrophin-1 and Atnl (DRPLA Dx); CBP (Creb-BP-global instability); VLDLR (Alzheimer's); Atxn7; Atxn10;
- Fragile X Syndrome: Genes linked to this disorder: FMR2; FXR1; FXR2; mGLURS;
- Secretase Related Disorders: Genes linked to this disorder: APH-1 (alpha and beta); Presenil n (Psenl); nicastrin (Ncstn); PEN-2;
- Others: Genes linked to this disorder: Nosl; Paipl; Nati; Nat2;
- Prion-related disorders: Gene linked to this disorder: Prp;
- ALS: Genes linked to this disorder: SOD1; ALS2; STEX; FUS; TARDBP; VEGF (VEGF-a; VEGF-b; VEGF-c);
- Drug addiction: Genes linked to this disorder: Prkce (alcohol); Drd2; Drd4; ABAT (alcohol); GRIA2; GrmS; Grinl; Htrlb; Grin2a; Drd3; Pdyn; Grial (alcohol);
- Autism: Genes linked to this disorder: Mecp2; BZRAP1; MDGA2; SemaSA; Neurexin 1; Fragile X (FMR2 (AFF2); FXR1; FXR2; MglurS);
- Alzheimer's Disease Genes linked to this disorder: El; CHIP; UCH; UBB; Tau; LRP; PICALM; Clusterin; PS1; SORL1; CR1; Vidlr; Ubal; Uba3; CHIP28 (Aqp1, Aquaporin 1); Uchll; Uch13; APP;
- Inflammation and Immune-related disorders Genes linked to this disorder: IL-10; IL-1 (IL-la; IL-1b); IL-13; IL-17 (IL-17a (CTLA8); IL-17b; IL-17c; IL-17d; IL-17f); 11-23; Cx3crl; ptpn22; TNFa; NOD2/CARD15 for IBD; IL-6; IL-12 (IL-12a; IL-12b); CTLA4; Cx3c11, AAT deficiency/mutations, AIDS (KIR3DL1, NKAT3, NKB1, ANIB11, KIR3DS1, IFNG, CXCL12, SDF1); Autoimmune lymphoproliferative syndrome (TNFRSF6, APT1, FAS, CD95, ALPS1A); Combined immunodeficiency, (IL2RG, SCIDX1, SCIDX, IMD4); HIV-1 (CCL5, SCYA5, D17S136E, TCP228), HIV susceptibility or infection (IL10, CSIF, CMKBR2, CCR2, CMKBR5, CCCKR5 (CCR5)); Immunodeficiencies (CD3E, CD3G, AICDA, AID, HIGM2, TNFRSF5, CD40, UNG, DGU, HIGM4, TNFSF5, CD4OLG, HIGM1, IGM, FOXP3, IPEX, AIID, XPID, PIDX, TNFRSF14B, TACI); Inflammation (IL-10, IL-1 (IL-la, IL-1b), IL-13, IL-17 (IL-17a (CTLA8), IL-17b, IL-17c, IL-17d, IL-17f), 11-23, Cx3crl, ptpn22, TNFa, NOD2/CARD15 for IBD, IL-6, IL-12 (IL-12a, IL-12b), CTLA4, Cx3c11); Severe combined immunodeficiencies (SCIDs) (JAK3, JAKL, DCLREIC, ARTEMIS, SCIDA, RAG1, RAG2, ADA, PTPRC, CD45, LCA, IL7R, CD3D, T3D, IL2RG, SCIDX1, SCIDX, IMD4);
- Parkinson's, Genes linked to this disorder: x-Synuclein; DJ-1; LRRK2; Parkin; PINK1;
- Blood and coagulation disorders: Genes linked to these disorders: Anemia (CDAN1, CDA1, RPS19, DBA, PKLR, PK1, NT5C3, UMPH I, PSN1, RHAG, RH50A, NRAMP2, SPTB, ALAS2, ANH I, ASB, ABCB7, ABC7, ASAT); Bare lymphocyte syndrome (TAPBP, TPSN, TAP2, ABCB3, PSF2, RINGI 1, MHC2TA, C2TA, RFX5, RFXAP, RFX5), Bleeding disorders (TBXA2R, P2RX I, P2X I); Factor H and factor H-like 1 (HF1, CFH, HUS); Factor V and factor VIII (MCFD2); Factor VII deficiency (F7); Factor X deficiency (F10); Factor XI deficiency (F11); Factor XII deficiency (F12, HAF); Factor XIIIA deficiency (F13A1, F13A); Factor XIIIB deficiency (F13B); Fanconi anemia (FANCA, FACA, FA1, FA, FAA, FAAP95, FAAP90, FLJ34064, FANCB, FANCC, FACC, BRCA2, FANCD1, FANCD2, FANCD, FACD, FAD, FANCE, FACE, FANCF, XRCC9, FANCG, BRIP1, BACH1, FANCJ, PHF9, FANCL, FANCM, ICIAA1596); Hemophagocytic lymphohistiocytosis disorders (PRF1, HPLH2, UNC13D, MUNC13-4, HPLH3, HLH3, FHL3); Hemophilia A (F8, F8C, HEMA); Hemophilia B (F9, HEMB), Hemorrhagic disorders (PI, ATT, F5); Leukocyde deficiencies and disorders (ITGB2, CD18, LCAMB, LAD, EIF2B1, EIF2BA, EIF2B2, EIF2B3, EIF2B5, LVWM, CACH, CLE, EIF2B4); Sickle cell anemia (HBB); Thalassemia (HBA2, HBB, HBD, LCRB, HBA1);

Cell dysregulation and oncology disorders: Genes linked to these disorders: B-cell non-Hodgkin lymphoma (BCL7A, BCL7); Leukemia (TALI TCL5, SCL, TAL2, FLT3, NBS 1, NBS, ZNFNIAI, IK1, LYF1, HOXD4, HOX4B, BCR, CML, PHL, ALL, ARNT, KRAS2, RASK2, GMPS, AFIO, ARHGEFI2, LARG, KIAA0382, CALM, CLTH, CEBPA, CEBP, CHIC2, BTL, FLT3, KIT, PBT, LPP, NPM1, NUP214, D9S46E, CAN, CAIN, RUNX 1, CBFA2, AML1, WHSC 1 LI, NSD3, FLT3, AFIQ, NPM 1, NUMA1, ZNF145, PLZF, PML, MYL, STAT5B, AFI 0, CALM, CLTH, ARLI 1, ARLTS1, P2RX7, P2X7, BCR, CML, PHL, ALL, GRAF, NFI, VRNF, WSS, NFNS, PTPNI 1, PTP2C, SHP2, NS 1, BCL2, CCND1, PRAD1, BCL1, TCRA, GATA1, GF1, ERYF1, NFE1, ABL1, NQO1, DIA4, NMOR1, NUP214, D9S46E, CAN, CAIN);

Metabolic, liver, kidney disorders: Genes linked to these disorders: Amyloid neuropathy (TTR, PALS); Amyloidosis (APOA1, APP, AAA, CVAP, AD1, GSN, FGA, LYZ, UR, PALS); Cirrhosis (KATI 8, KRT8, CaHIA, NAIC, TEX292, KIAA1988); Cystic fibrosis (CFTR, ABCC7, CF, MRP7); Glycogen storage diseases (SLC2A2, GLUT2, G6PC, G6PT, G6PT1, GAA, LAMP2, LAMPS, AGL, GDE, GBE1, GYS2, PYGL, PFKM); Hepatic adenoma, 142330 (TCF1, HNF1A, MODY3), Hepatic failure, early onset, and neurologic disorder (SCOD1, SCO1), Hepatic lipase deficiency (LIPC), Hepatoblastoma, cancer and carcinomas (CTNNB1, PDGFRL, PDGRL, PRLTS, AXIN1, AXIN, CTNNB1, TP53, P53, LFS1, IGF2R, MPRI, MET, CASP8, MCH5; Medullary cystic kidney disease (UMOD, HNFJ, FJHN, MCKD2, ADMCKD2); Phenylketonuria (PAH, PKU1, QDPR, DHPR, PTS); Polycystic kidney and hepatic disease (FCYT, PKHD1, ARPKD, PKD2, PKD4, PKDTS, PRKCSH, G19P1, PCLD, SEC63);

Muscular/Skeletal Disorders: Genes linked to these disorders: Becker muscular dystrophy (DMD, BMD, MYF6), Duchenne Muscular Dystrophy (DMD, BMD); Emery-Dreifuss muscular dystrophy (LMNA, LMN1, EMD2, FPLD, CMD1A, HGPS, LGMD1B, LMNA, LMN1, EMD2, FPLD, CMD1A); Facioscapulohumeral muscular dystrophy (FSHMD1A, FSHD1A); Muscular dystrophy (FKRP, MDC1C, LGMD2I, *LAMA2*, LAMM, LARGE, KIAA0609, MDC1D, FCMD, TTID, MYOT, CAPN3, CANP3, DYSF, LGMD2B, SGCG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMDIN, TRIM32, HT2A, LGMD2H, FKRP, MDC1C, LGMD2I, TTN, CMD1G, TMD, LGMD2J, POMT1, CAV3, LGMD1C, SEPN1, SELN, RSMD1, PLEC1, PLTN, EBS1); Osteopetrosis (LAPS, BMND1, LRP7, LR3, OPPG, VBCH2, CLCN7, CLC7, OPTA2, OSTMI, GL, TCIRGI, TIRC7, 0C116, OPTB1); Muscular atrophy (VAPB, VAPC, ALS8, SMN1, SMA1, SMA2, SMA3, SMA4, BSCL2, SPG17, GARS, SMAD1, CMT2D, HEXB, IGHMBP2, SMUBP2, CATF1, SMARD1);

Neurological and Neuronal disorders: Genes linked to these disorders: ALS (SOD1, ALS2, STEX, FUS, TARDBP, VEGF (VEGF-a, VEGF-b, VEGF-c); Alzheimer disease (APP, AAA, CVAP, AD1, APOE, AD2, PSEN2, AD4, STM2, APBB2, FE65L1, NOS3, PLAU, URK, ACE, DCPI, ACEI, MPO, PACIP1, PAXIPIL, PTIP, A2M, BLMH, BMH, PSEN1, AD3); Autism (Mecp2, BZRAP I, MDGA2, Sema5A, Neurex 1, GLO1, MECP2, RTT, PPMX, MRX16, MRX79, NLGN3, NLGN4, KIAA1260, AUTSX2); Fragile X Syndrome (FMR2, FXR1, FXR2, mGLUR5); Huntington's disease and disease like disorders (HD, IT15, PRNP, PRIP, JPH3, JP3, HDL2, TBP, SCA17); Parkinson disease (NR4A2, NURRI, NOT, TINUR, SNCAIP, TBP, SCA17, SNCA, NACP, PARK1, PARK4, DJ1, PARK7, LRRK2, PARKS, PINK1, PARK6, UCHL1, PARKS, SNCA, NACP, PARK1, PARK4, PRKN, PARK-2, PDJ, DBH, NDUFV2); Rett syndrome (MECP2, RTT, PPMX, MRX16, MRX79, CDKL5, STK9, MECP2, RTT, PPMX, MRX16, MRX79, x-Synuclein, DJ-1); Schizophrenia (Neuregulinl (Nrgl), Erb4 (receptor for Neuregulin), Complexinl (Cp1x1), Tphl Tryptophan hydroxylase, Tph2, Tryptophan hydroxylase 2, Neurexin 1, GSK3, GSK3a, GSK3b, 5-HTT (S1c6a4), COMT, DRD (Drd la), SLC6A3, DAOA, DTNBP1, Dao (Daol)); Secretase Related Disorders (APH-1 (alpha and beta), Preseni I in (Psenl), nicastrin, (Ncstn), PEN-2, Nosl, Parpl, Natl, Nat2); Trinucleotide Repeat Disorders (HTT (Huntington's Dx), SBMA/SMAX1/AR (Kennedy's Dx), FXN/X25 (Friedrich's Ataxia), ATX3 (Machado-Joseph's Dx), ATXN1 and ATXN2 (spinocerebellar ataxias), DMPK (myotonic dystrophy), Atrophin-1 and Atnl (DRPLA Dx), CBP (Creb-BP-global instability), VLDLR (Alzheimer's), Atxn7, Atxn10);

Occular-related disorders: Genes linked to these disorders: Age-related macular degeneration (Aber, Cc12, Cc2, cp (ceruloplasmin), Timp3, cathepsinD, Vldlr, Ccr2); Cataract (CRYAA, CRYA1, CRYBB2, CRYB2, PITX3, BFSP2, CP49, CP47, CRYAA, CRYA1, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQPO, CRYAB, CRYA2, CTPP2, CRYBB1, CRYGD, CRYG4, CRYBB2, CRYB2, CRYGC, CRYG3, CCL, CRYAA, CRYA1, GJA8, CX50, CAE1, GJA3, CX46, CZP3, CAE3, CCM1, CAM, KRIT1); Corneal clouding and dystrophy (APOA1, TGFBI, CSD2, CDGG1, CSD, BIGH3, CDG2, TACSTD2, TROP2, MIS1, VSX1, RINX, PPCD, PPD, KTCN, COL8A2, FECD, PPCD2, PIP5K3, CFD); Cornea plana congenital (KERA, CNA2); Glaucoma (MYOC, TIGR, GLCIA, JOAG, GPOA, OPTN, GLCIE, FIP2, HYPL, NRP, CYP1B1, GLC3A, OPAL, NTG, NPG, CYP1B1, GLC3A); Leber congenital amaurosis (CRB1, RP12, CRX, CORD2, CRD, RPGRIP1, LCA6, CORD9, RPE65, RP20, AIPL1, LCA4, GUCY2D, GUC2D, LCA1, CORD6, RDH12, LCA3); Macular dystrophy (ELOVL4, ADMD, STGD2, STGD3, RDS, RP7, PRPH2, PRPH, AVMD, AOFMD, VMD2);

P13K/AKT Cellular Signaling disorders: Genes linked to these disorders: PRKCE; ITGAM; ITGA5; IRAK1; PRKAA2; EIF2AK2; PTEN; EIF4E; PRKCZ; GRK6; MAPK1; TSC1; PLK1; AKT2; IKBKB; PIK3CA; CDK8; CDKNIB; NFKB2; BCL2; PIK3CB; PPP2R1A; MAPK8; BCL2L1; MAPK3; TSC2; ITGAl; KRAS; EIF4EBP1; RELA; PRKCD; NOS3;

PRKAA1; MAPK9; CDK2; PPP2CA; PIM1; ITGB7; YWHAZ; ILK; TP53; RAF1; IKBKG; RELB; DYRKIA; CDKNIA; ITGB1; MAP2K2; JAK1; AKT1; JAK2; PIK3R1; CHUK; PDPK1; PPP2R5C; CTNNB1; MAP2K1; NFKB1; PAK3; ITGB3; CCND1; GSK3A; FRAP1; SFN; ITGA2; TTK; CSNK1A1; BRAF; GSK3B; AKT3; FOXO1; SOK; HS P90AA1; RP S 6KB1;

ERK/MAPK Cellular Signaling disorders: Genes linked to these disorders: PRKCE; ITGAM; ITGA5; HSPB1; IRAK1; PRKAA2; EIF2AK2; RAC1; RAPIA; TLN1; EIF4E; ELK1; GRK6; MAPK1; RAC2; PLK1; AKT2; PIK3CA; CDK8; CREB1; PRKCI; PTK2; FOS; RPS6KA4; PIK3CB; PPP2RIA; PIK3C3; MAPK8; MAPK3; ITGA1; ETS1; KRAS; MYCN; EIF4EBP1; PPARG; PRKCD; PRKAA1; MAPK9; SRC; CDK2; PPP2CA; PIM1; PIK3C2A; ITGB7; YWHAZ; PPPICC; KSR1; PXN; RAF1; FYN; DYRKIA; ITGB1; MAP2K2; PAK4; PIK3R1; STAT3; PPP2R5C; MAP2K1; PAK3; ITGB3; ESR1; ITGA2; MYC; TTK; CSNK1A1; CRKL; BRAE; ATF4; PRKCA; SRF; STAT1; SGK;

Glucocorticoid Receptor Cellular Signaling disorders: Genes linked to these disorders: RAC1; TAF4B; EP300; SMAD2; TRAF6; PCAF; ELK1; MAPK1; SMAD3; AKT2; IKBKB; NCOR2; UBE2I; PIK3CA; CREB1; FOS; HSPA5; NFKB2; BCL2; MAP3K14; STAT5B; PIK3CB; PIK3C3; MAPK8; BCL2L1; MAPK3; TSC22D3; MAPK10; NRIP1; KRAS; MAPK13; RELA; STAT5A; MAPK9; NOS2A; PBX1; NR3C1; PIK3C2A; CDKNIC; TRAF2; SERPINE1; NCOA3; MAPK14; TNF; RAF1; IKBKG; MAP3K7; CREBBP; CDKNIA; MAP2K2; JAK1; IL8; NCOA2; AKT1; JAK2; PIK3R1; CHUK; STAT3; MAP2K1; NFKB1; TGFBR1; ESR1; SMAD4; CEBPB; JUN; AR; AKT3; CCL2; MMP 1; STAT1; IL6; HSP90AA1;

Axonal Guidance Cellular Signaling disorders: Genes linked to these disorders: PRKCE; ITGAM; ROCK1; ITGA5; CXCR4; ADAM12; IGF1; RAC1; RAPIA; El F4E; PRKCZ; NRP1; NTRK2; ARHGEF7; SMO; ROCK2; MAPK1; PGF; RAC2; PTPN11; GNAS; AKT2; PIK3CA; ERBB2; PRKCI; PTK2; CFL1; GNAQ; PIK3CB; CXCL12; PIK3C3; WNT11; PRKD1; GNB2L1; ABL1; MAPK3; ITGA1; KRAS; RHOA; PRKCD; PIK3C2A; ITGB7; GLI2; PXN; VASP; RAF1; FYN; ITGB1; MAP2K2; PAK4; ADAM17; AKT1; PIK3R1; GUI; WNT5A; ADAM10; MAP2K1; PAK3; ITGB3; CDC42; VEGFA; ITGA2; EPHA8; CRKL; RND1; GSK3B; AKT3; PRKCA;

Ephrin Recptor Cellular Signaling disorders: Genes linked to these disorders: PRKCE; ITGAM; ROCK1; ITGA5; CXCR4; IRAK1; PRKAA2; EIF2AK2; RAC1; RAPIA; GRK6; ROCK2; MAPK1; PGF; RAC2; PTPN11; GNAS; PLK1; AKT2; DOK1; CDK8; CREB1; PTK2; CFL1; GNAQ; MAP3K14; CXCL12; MAPK8; GNB2L1; ABL1; MAPK3; ITGA1; KRAS; RHOA; PRKCD; PRKAA1; MAPK9; SRC; CDK2; PIM1; ITGB7; PXN; RAF1; FYN; DYRKIA; ITGB1; MAP2K2; PAK4; AKT1; JAK2; STAT3; ADAM10; MAP2K1; PAK3; ITGB3; CDC42; VEGFA; ITGA2; EPHA8; TTK; CSNK1A1; CRKL; BRAF; PTPN13; ATF4; AKT3; SGK;

Actin Cytoskeleton Cellular Signaling disorders: Genes linked to these disorders: ACTN4; PRKCE; ITGAM; ROCK1; ITGA5; IRAK1; PRKAA2; EIF2AK2; RAC1; INS; ARHGEF7; GRK6; ROCK2; MAPK1; RAC2; PLK1; AKT2; PIK3CA; CDK8; PTK2; CFL1; PIK3CB; MYH9; DIAPH1; PIK3C3; MAPK8; F2R; MAPK3; SLC9A1; ITGA1; KRAS; RHOA; PRKCD; PRKAA1; MAPK9; CDK2; PIM1; PIK3C2A; ITGB7; PPP1CC; PXN; VIL2; RAF1; GSN; DYRKIA; ITGB1; MAP2K2; PAK4; PIP5KIA; PIK3R1; MAP2K1; PAK3; ITGB3; CDC42; APC; ITGA2; TTK; CSNK1A1; CRKL; BRAF; VAV3; SGK;

Huntington's Disease Cellular Signaling disorders: Genes linked to these disorders: PRKCE; IGF1; EP300; RCOR1; PRKCZ; HDAC4; TGM2; MAPK1; CAPNS1; AKT2; EGFR; NCOR2; SP1; CAPN2; PIK3CA; HDAC5; CREB1; PRKC1; HS PA5; REST; GNAQ; PIK3CB; PIK3C3; MAPK8; IGFIR; PRKD1; GNB2L1; BCL2L1; CAPN1; MAPK3; CASP8; HDAC2; HDAC7A; PRKCD; HDAC11; MAPK9; HDAC9; PIK3C2A; HDAC3; TP53; CASP9; CREBBP; AKT1; PIK3R1; PDPK1; CASP1; APAF1; FRAP1; CASP2; JUN; BAX; ATF4; AKT3; PRKCA; CLTC; SGK; HDAC6; CASP3;

Apoptosis Cellular Signaling disorders: Genes linked to these disorders: PRKCE; ROCK1; BID; IRAK1; PRKAA2; EIF2AK2; BAK1; BIRC4; GRK6; MAPK1; CAPNS1; PLK1; AKT2; IKBKB; CAPN2; CDK8; FAS; NFKB2; BCL2; MAP3K14; MAPK8; BCL2L1; CAPN1; MAPK3; CASP8; KRAS; RELA; PRKCD; PRKAA1; MAPK9; CDK2; PIM1; TP53; TNF; RAF1; IKBKG; RELB; CASP9; DYRKIA; MAP2K2; CHUK; APAF1; MAP2K1; NFKB1; PAK3; LMNA; CASP2; BIRC2; TTK; CSNK1A1; BRAF; BAX; PRKCA; SGK; CASP3; BTRC3; PARPI;

B Cell Receptor Cellular Signaling disorders: Genes linked to these disorders: RAC1; PTEN; LYN; ELK1; MAPK1; RAC2; PTPN11; AKT2; IKBKB; PIK3CA; CREB1; SYK; NFKB2; CAMK2A; MAP3K14; PIK3CB; PIK3C3; MAPK8; BCL2L1; ABL1; MAPK3; ETS1; KRAS; MAPK13; RELA; PTPN6; MAPK9; EGR1; PIK3C2A; BTK; MAPK14; RAF1; IKBKG; RELB; MAP3K7; MAP2K2; AKT1; PIK3R1; CHUK; MAP2K1; NFKB1; CDC42; GSK3A; FRAP1; BCL6; BCL10; JUN; GSK3B; ATF4; AKT3; VAV3; RPS6KB1;

Leukocyte Extravasation Cellular Signaling disorders: Genes linked to these disorders: ACTN4; CD44; PRKCE; ITGAM; ROCK1; CXCR4; CYBA; RAC1; RAPIA; PRKCZ; ROCK2; RAC2; PTPN11; MMP14; PIK3CA; PRKCI; PTK2; PIK3CB; CXCL12; PIK3C3; MAPK8; PRKD1; ABL1; MAPK10; CYBB; MAPK13; RHOA; PRKCD; MAPK9; SRC; PIK3C2A; BTK; MAPK14; NOX1; PXN; VIL2; VASP; ITGB1; MAP2K2; CTNND1; PIK3R1; CTNNB1; CLDN1; CDC42; FUR; ITK; CRKL; VAV3; CTTN; PRKCA; MMP1; MMP9;

Integrin Cellular Signaling disorders: Genes linked to these disorders: ACTN4; ITGAM; ROCK1; ITGA5; RAC1; PTEN; RAPIA; TLN1; ARHGEF7; MAPK1; RAC2; CAPNS1; AKT2; CAPN2; PIK3CA; PTK2; PIK3CB; PIK3C3; MAPK8; CAVI; CAPN1; ABL1; MAPK3; ITGA1; KRAS; RHOA; SRC; PIK3C2A; ITGB7; PPP1CC; ILK; PXN; VASP; RAF1; FYN; ITGB1; MAP2K2; PAK4; AKT1; PIK3R1; TNK2; MAP2K1; PAK3; ITGB3; CDC42; RND3; ITGA2; CRKL; BRAF; GSK3B; AKT3;

Acute Phase Response Cellular Signaling disorders: Genes linked to these disorders: IRAK1; SOD2; MYD88; TRAF6; ELK1; MAPK1; PTPN11; AKT2; IKBKB; PIK3CA; FOS; NFKB2; MAP3K14; PIK3CB; MAPK8; RIPK1; MAPK3; IL6ST; KRAS;

MAPK13; IL6R; RELA; SOCS1; MAPK9; FTL; NR3C1; TRAF2; SERPINE1; MAPK14; TNF; RAF1; PDK1; IKBKG; RELB; MAP3K7; MAP2K2; AKT1; JAK2; PIK3R1; CHUK; STAT3; MAP2K1; NFKB1; FRAP1; CEBPB; JUN; AKT3; ILIR1; IL6;

PTEN Cellular Signaling disorders: Genes linked to these disorders: ITGAM; ITGA5; RAC1; PTEN; PRKCZ; BCL2L11; MAPK1; RAC2; AKT2; EGFR; IKBKB; CBL; PIK3CA; CDKNIB; PTK2; NFKB2; BCL2; PIK3CB; BCL2L1; MAPK3; ITGA1; KRAS; ITGB7; ILK; PDGFRB; INSR; RAF1; IKBKG; CASP9; CDKNIA; ITGB1; MAP2K2; AKT1; PIK3R1; CHUK; PDGFRA; PDPK1; MAP2K1; NFKB1; ITGB3; CDC42; CCND1; GSK3A; ITGA2; GSK3B; AKT3; FOXO1; CASP3;

p53 Cellular Signaling disorders: Genes linked to these disorders: RPS6KB1 PTEN; EP300; BBC3; PCAF; FASN; BRCA1; GADD45A; BIRC5; AKT2; PIK3CA; CHEK1; TP53INP1; BCL2; PIK3CB; PIK3C3; MAPK8; THBS 1; ATR; BCL2L1; E2F1; PMAIP1; CHEK2; TNFASF10B; TP73; RB1; HDAC9; CDK2; PIK3C2A; MAPK14; TP53; LRDD; CDKNIA; HIPK2; AKT1; PIK3R1; RAM2B; APAF1; CTNNB1; SIRT1; CCND1; PRKDC; ATM; SFN; CDKN2A; JUN; SNAI2; GSK3B; BAX; AKT3;

Aryl Hydrocarbon Receptor Cellular Signaling disorders: Genes linked to these disorders: HSPB1; EP300; FASN; TGM2; RXRA; MAPK1; NQO1; NCOR2; SP1; ARNT; CDKNIB; FOS; CHEK1; SMARCA4; NFKB2; MAPK8; ALDHIA1; ATR; E2F1; MAPK3; NRIP1; CHEK2; RELA; TP73; GSTP1; RB1; SRC; CDK2; AHR; NFE2L2; NCOA3; TP53; TNF; CDKNIA; NCOA2; APAF1; NFKB1; CCND1; ATM; ESR1; CDKN2A; MYC; JUN; ESR2; BAX; IL6; CYP1B1; HSP90AA1;

Xenobiotic Metabolism Cellular Signaling disorders: Genes linked to these disorders: PRKCE; EP300; PRKCZ; RXRA; MAPK1; NQO1; NCOR2; PIK3CA; ARNT; PRKCI; NFKB2; CAMK2A; PIK3CB; PPP2RIA; PIK3C3; MAPK8; PRKD1; ALDHIA1; MAPK3; NRIP1; KRAS; MAPK13; PRKCD; GSTP1; MAPK9; NOS2A; ABCB1; AHR; PPP2CA; FTL; NFE2L2; PIK3C2A; PPARGCIA; MAPK14; TNF; RAF1; CREBBP; MAP2K2; PIK3R1; PPP2R5C; MAP2K1; NFKB1; KEAP1; PRKCA; EIF2AK3; IL6; CYP1B1; HSP90AA1;

SAPL/JNK Cellular Signaling disorders: Genes linked to these disorders: PRKCE; IRAK1; PRKAA2; EIF2AK2; RAC1; ELK1; GRK6; MAPK1; GADD45A; RAC2; PLK1; AKT2; PIK3CA; FADD; CDK8; PIK3CB; PIK3C3; MAPK8; RIPK1; GNB2L1; IRS1; MAPK3; MAPK10; DAXX; KRAS; PRKCD; PRKAA1; MAPK9; CDK2; PIM1; PIK3C2A; TRAF2; TP53; LCK; MAP3K7; DYRKIA; MAP2K2; PIK3R1; MAP2K1; PAK3; CDC42; JUN; TTK; CSNK1A1; CRKL; BRAF; SGK;

PPAr/RXR Cellular Signaling disorders: Genes linked to these disorders: PRKAA2; EP300; INS; SMAD2; TRAF6; PPARA; FASN; RXRA; MAPK1; SMAD3; GNAS; IKBKB; NCOR2; ABCA1; GNAQ; NFKB2; MAP3K14; STAT5B; MAPK8; IASI; MAPK3; KRAS; RELA; PRKAA1; PPARGCIA; NCOA3; MAPK14; INSR; RAF1; IKBKG; RELB; MAP3K7; CREBBP; MAP2K2; JAK2; CHUK; MAP2K1; NFKB1; TGF-BAI; SMAD4; JUN; ILIR1; PRKCA; IL6; HSP90AA1; ADIPOO;

NF-KB Cellular Signaling disorders: Genes linked to these disorders: IRAK1; EIF2AK2; EP300; INS; MYD88; PRKCZ: TRAF6; TBK1; AKT2; EGFR; IKBKB; PIK3CA; BTRC; NFKB2; MAP3K14; PIK3CB; PIK3C3; MAPK8; RIPK1; HDAC2; KRAS; RELA; PIK3C2A; TRAF2; TLR4: PDGFRB; TNF; INSR; LCK; IKBKG; RELB; MAP3K7; CREBBP; AKT1; PIK3R1; CHUK; PDGFRA; NFKB1; TLR2; BCL10; GSK3B; AKT3; TNFAIP3; ILIR1;

Neuregulin Cellular Signaling disorders: Genes linked to these disorders: ERBB4; PRKCE; ITGAM; ITGA5: PTEN; PRKCZ; ELK1; MAPK1; PTPN11; AKT2; EGFR; ERBB2; PRKCI; CDKNIB; STAT5B; PRKD1; MAPK3; ITGA1; KRAS; PRKCD; STAT5A; SRC; ITGB7; RAF1; ITGB1; MAP2K2; ADAM17; AKT1; PIK3R1; PDPK1; MAP2K1; ITGB3; EREG; FRAP1; PSEN1; ITGA2; MYC; NRG1; CRKL; AKT3; PRKCA; HS P90AA1; RPS6KB1;

Wnt and Beta catenin Cellular Signaling disorders: Genes linked to these disorders: CD44; EP300; LRP6; DVL3; CSNKIE; GJA1; SMO; AKT2; PIN1; CDH1; BTRC; GNAQ; MARK2; PPP2RIA; WNT11; SRC; DKK1; PPP2CA; SOX6; SFRP2: ILK; LEF1; SOX9; TP53; MAP3K7; CREBBP; TCF7L2; AKT1; PPP2R5C; WNT5A; LAPS; CTNNB1; TGFBR1; CCND1; GSK3A; DVL1; APC; CDKN2A; MYC; CSNK1A1; GSK3B; AKT3; SOX2;

Insulin Receptor Signaling disorders: Genes linked to these disorders: PTEN; INS; EIF4E; PTPN1; PRKCZ; MAPK1; TSC1; PTPN11; AKT2; CBL; PIK3CA; PRKCI; PIK3CB; PIK3C3; MAPK8; IASI; MAPK3; TSC2; KRAS; EIF4EBP1; SLC2A4; PIK3C2A; PPP1CC; INSR; RAF1; FYN; MAP2K2; JAK1; AKT1; JAK2; PIK3R1; PDPK1; MAP2K1; GSK3A; FRAP1; CRKL; GSK3B; AKT3; FOXO1; SGK; RPS6KB1;

IL-6 Cellular Signaling disorders: Genes linked to these disorders: HSPB1; TRAF6; MAPKAPK2; ELK1; MAPK1; PTPN11; IKBKB; FOS; NFKB2: MAP3K14; MAPK8; MAPK3; MAPK10; IL6ST; KRAS; MAPK13; IL6R; RELA; SOCS1; MAPK9; ABCB1; TRAF2; MAPK14; TNF; RAF1; IKBKG; RELB; MAP3K7; MAP2K2; IL8; JAK2; CHUK; STAT3; MAP2K1; NFKB1; CEBPB; JUN; ILIR1; SRF; IL6;

Hepatic Cholestasis Cellular Signaling disorders: Genes linked to these disorders: PRKCE; IRAK1; INS; MYD88; PRKCZ; TRAF6; PPARA; RXRA; IKBKB; PRKCI; NFKB2; MAP3K14; MAPK8; PRKD1; MAPK10; RELA; PRKCD; MAPK9; ABCB1; TRAF2; TLR4; TNF; INSR; IKBKG; RELB; MAP3K7; IL8; CHUK; NR1H2; TJP2; NFKB1; ESR1; SREBF1; FGFR4; JUN; ILIR1; PRKCA; IL6;

IGF-1 Cellular Signaling disorders: Genes linked to these disorders: IGF1; PRKCZ; ELK1; MAPK1; PTPN11; NEDD4; AKT2; PIK3CA; PRKCI; PTK2; FOS; PIK3CB; PIK3C3; MAPK8; IGFIR; IRS1; MAPK3; IGFBP7; KRAS; PIK3C2A; YWHAZ; PXN; RAF1; CASP9; MAP2K2; AKT1; PIK3R1; PDPK1; MAP2K1; IGFBP2; SFN; JUN; CYR61; AKT3; FOXO1; SRF; CTGF; RPS6KB1;

NRF2-mediated Oxidative Stress Response Signaling disorders: Genes linked to these disorders: PRKCE; EP300; SOD2; PRKCZ; MAPK1; SQSTM1; NQO1; PIK3CA; PRKCI; FOS; PIK3CB; PIK3C3; MAPK8; PRKD1; MAPK3; KRAS; PRKCD; GSTP1; MAPK9; FTL; NFE2L2; PIK3C2A; MAPK14; RAF1; MAP3K7; CREBBP; MAP2K2; AKT1; PIK3R1;

MAP2K1; PPIB; JUN; KEAP1; GSK3B; ATF4; PRKCA; EIF2AK3; HSP90AA1;

Hepatic Fibrosis/Hepatic Stellate Cell Activation Signaling disorders: Genes linked to these disorders: EDN1; IGF1; KDR; FLT1; SMAD2; FGFR1; MET; PGF; SMAD3; EGFR; FAS; CSF1; NFKB2; BCL2; MYH9; IGF1R; IL6R; RELA; TLR4; PDGFRB; TNF; RELB; IL8; PDGFRA; NFKB1; TGFBR1; SMAD4; VEGFA; BAX; ILIR1; CCL2; HGF; MMP1; STAT1; IL6; CTGF; MMP9;

PPAR Signaling disorders: Genes linked to these disorders: EP300; INS; TRAF6; PPARA; RXRA; MAPK1; IKBKB; NCOR2; FOS; NFKB2; MAP3K14; STAT5B; MAPK3; NRIP1; KRAS; PPARG; RELA; STAT5A; TRAF2; PPARGCIA; PDGFRB; TNF; INSR; RAF1; IKBKG; RELB; MAP3K7; CREBBP; MAP2K2; CHUK; PDGFRA; MAP2K1; NFKB1; JUN; ILIR1; HSP90AA1;

Fc Epsilon RI Signaling disorders: Genes linked to these disorders: PRKCE; RAC1; PRKCZ; LYN; MAPK1; RAC2; PTPN11; AKT2; PIK3CA; SYK; PRKCI; PIK3CB; PIK3C3; MAPK8; PRKD1; MAPK3; MAPK10; KRAS; MAPK13; PRKCD; MAPK9; PIK3C2A; BTK; MAPK14; TNF; RAF1; FYN; MAP2K2; AKT1; PIK3R1; PDPK1; MAP2K1; AKT3; VAV3; PRKCA;

G-Protein Coupled Receptor Signaling disorders: Genes linked to these disorders: PRKCE; RAPIA; RGS16; MAPK1; GNAS; AKT2; IKBKB; PIK3CA; CREB1; GNAQ; NFKB2; CAMK2A; PIK3CB; PIK3C3; MAPK3; KRAS; RELA; SRC; PIK3C2A; RAF1; IKBKG; RELB; FYN; MAP2K2; AKT1; PIK3R1; CHUK; PDPK1; S TAT3; MAP2K1; NFKB1; BRAF; ATF4; AKT3; PRKCA;

Inositol Phosphate Metabolism Signaling disorders: Genes linked to these disorders: PRKCE; IRAK1; PRKAA2; EIF2AK2; PTEN; GRK6; MAPK1; PLK1; AKT2; PIK3CA; CDK8; PIK3CB; PIK3C3; MAPK8; MAPK3; PRKCD; PRKAA1; MAPK9; CDK2; PIM1; PIK3C2A; DYRKIA; MAP2K2; PIP5K1A; PIK3R1; MAP2K1; PAK3; ATM; TTK; CSNK1A1; BRAF; SGK;

PDGF Signaling disorders: Genes linked to these disorders: EIF2AK2; ELK1; ABL2; MAPK1; PIK3CA; FOS; PIK3CB; P IK3 C3; MAPK8; CAVI; ABL1; MAPK3; KRAS; SRC; PIK3C2A; PDGFRB; RAF1; MAP2K2; JAK1; JAK2; PIK3R1; PDGFRA; STAT3; SPHK1; MAP2K1; MYC; JUN; CRKL; PRKCA; SRF; STAT1; SPHK2 VEGF Signaling disorders: Genes linked to these disorders: ACTN4; ROCK1; KDR; FLT1; ROCK2; MAPK1; PGF; AKT2; PIK3CA; ARNT; PTK2; BCL2; PIK3CB; PIK3C3; BCL2L1; MAPK3; KRAS; HIFIA; NOS3; PIK3C2A; PXN; RAF1; MAP2K2; ELAVL1; AKT1; PIK3R1; MAP2K1; SFN; VEGFA; AKT3; FOXO1; PRKCA;

Natural Killer Cell Signaling disorders: Genes linked to these disorders: PRKCE; RAC1; PRKCZ; MAPK1; RAC2; PTPN11; KIR2DL3; AKT2; PIK3CA; SYK; PRKCI; PIK3CB; PIK3C3; PRKD1; MAPK3; KRAS; PRKCD; PTPN6; PIK3C2A; LCK; RAF1; FYN; MAP2K2; PAK4; AKT1; PIK3R1; MAP2K1; PAK3; AKT3; VAV3; PRKCA;

Cell Cycle: GI/S Checkpoint Regulation Signaling disorders: Genes linked to these disorders: HDAC4; SMAD3; SUV39H1; HDAC5; CDKNIB; BTRC; ATR; ABL1; E2F1; HDAC2; HDAC7A; RB1; HDAC11; HDAC9; CDK2; E2F2; HDAC3; TP53; CDKNIA; CCND1; E2F4; ATM; RBL2; SMAD4; CDKN2A; MYC; NRG1; GSK3B; RBL1; HDAC6;

T Cell Receptor Signaling disorders: Genes linked to these disorders: RAC1; ELK1; MAPK1; IKBKB; CBL; PIK3CA; FOS; NFKB2; PIK3CB; PIK3C3; MAPK8; MAPK3; KRAS; RELA, PIK3C2A; BTK; LCK; RAF1; IKBKG; RELB, FYN; MAP2K2; PIK3R1; CHUK; MAP2K1; NFKB1; ITK; BCL10; JUN; VAV3;

Death Receptor disorders: Genes linked to these disorders: CRADD; HSPB1; BID; BIRC4; TBK1; IKBKB; FADD; FAS; NFKB2; BCL2; MAP3K14; MAPK8; RIPK1; CASP8; DAXX; TNFRSF10B; RELA; TRAF2; TNF; IKBKG; RELB; CASP9; CHUK; APAF1; NFKB1; CASP2; BIRC2; CASP3; BIRC3;

FGF Cell Signaling disorders: Genes linked to these disorders: RAC1; FGFR1; MET; MAPKAPK2; MAPK1; PTPN11; AKT2; PIK3CA; CREB1; PIK3CB; PIK3C3; MAPK8; MAPK3; MAPK13; PTPN6; PIK3C2A; MAPK14; RAF1; AKT1; PIK3R1; STAT3; MAP2K1; FGFR4; CRKL; ATF4; AKT3; PRKCA; HGF;

GM-CSF Cell Signaling disorders: Genes linked to these disorders: LYN; ELK1; MAPK1; PTPN11; AKT2; PIK3CA; CAMK2A; STAT5B; PIK3CB; PIK3C3; GNB2L1; BCL2L1; MAPK3; ETS1; KRAS; RUNX1; PIM1; PIK3C2A; RAF1; MAP2K2; AKT1; JAK2; PIK3R1; STAT3; MAP2K1; CCND1; AKT3; STAT1;

Amyotrophic Lateral Sclerosis Cell Signaling disorders: Genes linked to these disorders: BID; IGF1; RAC1; BIRC4; PGF; CAPNS1; CAPN2; PIK3CA; BCL2; PIK3CB; PIK3C3; BCL2L1; CAPN1; PIK3C2A; TP53; CASP9; PIK3R1; RAB5A; CASP1; APAF1; VEGFA; BIRC2; BAX; AKT3; CASP3; BIRC3 PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKNIA; MAP2K2; JAK1; AKT1; JAK2; PIK3R1; STAT3; MAP2K1; FRAP1; AKT3; STAT1;

JAK/Stat Cell Signaling disorders: Genes linked to these disorders: PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKNIA; MAP2K2; JAK1; AKT1; JAK2; PIK3R1; STAT3; MAP2K1; FRAP1; AKT3; STAT1;

Nicotinate and Nicotinamide Metabolism Cell Signaling disorders: Genes linked to these disorders: PRKCE; IRAK1; PRKAA2; EIF2AK2; GRK6; MAPK1; PLK1; AKT2; CDK8; MAPK8; MAPK3; PRKCD; PRKAA1; PBEF1; MAPK9; CDK2; PIM1; DYRKIA; MAP2K2; MAP2K1; PAK3; NT5E; TTK; CSNKIA1; BRAF; SGK;

Chemokine Cell Signaling disorders: Genes linked to these disorders: CXCR4; ROCK2; MAPK1; PTK2; FOS; CFL1; GNAQ; CAMK2A; CXCL12; MAPK8; MAPK3; KRAS; MAPK13; RHOA; CCR3; SRC; PPPICC; MAPK14; NOX1; RAF1; MAP2K2; MAP2K1; JUN; CCL2; PRKCA;

IL-2 Cell Signaling disorders: Genes linked to these disorders: ELK1; MAPK1; PTPN11; AKT2; PIK3CA; SYK; FOS; STAT5B; PIK3CB; PIK3C3; MAPK8; MAPK3; KRAS; SOCS1; STAT5A; PIK3C2A; LCK; RAF1; MAP2K2; JAK1; AKT1; PIK3R1; MAP2K1; JUN; AKT3;

Synaptic Long Term Depression Signaling disorders: Genes linked to these disorders: PRKCE; IGF1;

PRKCZ; PRDX6; LYN; MAPK1; GNAS; PRKCI; GNAQ; PPP2R1A; IGF1R; PRKD1; MAPK3; KRAS; GRN; PRKCD; NOS3; NOS2A; PPP2CA; YWHAZ; RAF1; MAP2K2; PPP2R5C; MAP2K1; PRKCA;

Estrogen Receptor Cell Signaling disorders: Genes linked to these disorders: TAF4B; EP300; CARM1; PCAF; MAPK1; NCOR2; SMARCA4; MAPK3; NRIP1; KRAS; SRC; NR3C1; HDAC3; PPARGC1A; RBM9; NCOA3; RAF1; CREBBP; MAP2K2; NCOA2; MAP2K1; PRKDC; ESR1; ESR2;

Protein Ubiquitination Pathway Cell Signaling disorders: Genes linked to these disorders: TRAF6; SMURF1; BIRC4; BRCA1; UCHL1; NEDD4; CBL; UBE2I; BTRC; HSPA5; USP7; USP10; FBXW7; USP9X; STUB1; USP22; B2M; BIRC2; PARK2; USP8; USP1; VHL; HSP90AA1; BIRC3;

IL-10 Cell Signaling disorders: Genes linked to these disorders: TRAF6; CCR1; ELK1; IKBKB; SP1; FOS; NFKB2; MAP3K14; MAPK8; MAPK13; RELA; MAPK14; TNF; IKBKG; RELB; MAP3K7; JAK1; CHUK; STAT3; NFKB1; JUN; IL1R1; IL6;

VDR/RXR Activation Signaling disorders: Genes linked to these disorders: PRKCE; EP300; PRKCZ; RXRA; GADD45A; HES1; NCOR2; SP1; PRKCI; CDKN1B; PRKD1; PRKCD; RUNX2; KLF4; YY1; NCOA3; CDKN1A; NCOA2; SPP1; LAPS; CEBPB; FOXO1; PRKCA;

TGF-beta Cell Signaling disorders: Genes linked to these disorders: EP300; SMAD2; SMURF1; MAPK1; SMAD3; SMAD1; FOS; MAPK8; MAPK3; KRAS; MAPK9; RUNX2; SERPINE1; RAF1; MAP3K7; CREBBP; MAP2K2; MAP2K1; TGFBR1; SMAD4; JUN; SMAD5;

Toll-like Receptor Cell Signaling disorders: Genes linked to these disorders: IRAK1; EIF2AK2; MYD88; TRAF6; PPARA; ELK1; IKBKB; FOS; NFKB2; MAP3K14; MAPK8; MAPK13; RELA; TLR4; MAPK14; IKBKG; RELB; MAP3K7; CHUK; NFKB1; TLR2; JUN;

p38 MAPK Cell Signaling disorders: Genes linked to these disorders: HSPB1; IRAK1; TRAF6; MAPKAPK2; ELK1; FADD; FAS; CREB1; DDIT3; RPS6KA4; DAXX; MAPK13; TRAF2; MAPK14; TNF; MAP3K7; TGFBR1; MYC; ATF4; IL1R1; SRF; STAT1; and Neurolrophin/TRK Cell Signaling disorders: Genes linked to these disorders: NTRK2; MAPK1; PTPN11; PIK3CA; CREB1; FOS; PIK3CB; PIK3C3; MAPK8; MAPK3; KRAS; PIK3C2A; RAF1; MAP2K2; AKT1; PIK3R1; PDPK1; MAP2K1; CDC42; JUN; ATF4.

Other cellular dysfunction disorders linked to a genetic modification are contemplated herein for example, FXR/RXR Activation, Synaptic Long Term Potentiation, Calcium Signaling EGF Signaling, Hypoxia Signaling in the Cardiovascular System, LPS/IL-1 Mediated Inhibition of RXR Function LXR/RXR Activation, Amyloid Processing, IL-4 Signaling, Cell Cycle: G2/M DNA Damage Checkpoint Regulation, Nitric Oxide Signaling in the Cardiovascular System Purine Metabolism, cAMP-mediated Signaling, Mitochondrial Dysfunction Notch Signaling Endoplasmic Reticulum Stress Pathway Pyrimidine Metabolism, Parkinson's Signaling Cardiac & Beta Adrenergic Signaling Glycolysis/Gluconeogenesis Interferon Signaling Sonic Hedgehog Signaling Glycerophospholipid Metabolism, Phosphatidyl Degradation, Tryptophan Metabolism Lysine Degradation Nucleotide Excision Repair Pathway, Starch and Sucrose Metabolism, Aminosugars Metabolism Arachidonic Acid Metabolism, Circadian Rhythm Signaling, Coagulation System Dopamine Receptor Signaling, Glutathione Metabolism Glycerolipid Metabolism Linoleic Acid Metabolism Methionine Metabolism Pyruvate Metabolism Arginine and Praline Metabolism, Eicosanoid Signaling Fructose and Mannose Metabolism, Galactose Metabolism Stilbene, Coumarine and Lignin Biosynthesis Antigen Presentation Pathway, Biosynthesis of Steroids Butanoate Metabolism Citrate Cycle Fatty Acid Metabolism Glycerophospholipid Metabolism, Histidine Metabolism Inositol Metabolism Metabolism of Xenobiotics by Cytochrome p450, Methane Metabolism, Phenylalanine Metabolism, Propanoate Metabolism Selenoamino Acid Metabolism Sphingolipid Metabolism Aminophosphonate Metabolism, Androgen and Estrogen Metabolism Ascorbate and Aldarate Metabolism, Bile Acid Biosynthesis Cysteine Metabolism Fatty Acid Biosynthesis Glutamate Receptor Signaling, NRF2-mediated, Oxidative Stress Response Pentose Phosphate Pathway, Pentose and Glucuronate Interconversions, Retinol Metabolism Riboflavin Metabolism Tyrosine Metabolism Ubiquinone Biosynthesis Valine, Leucine and Isoleucine Degradation Glycine, Serine and Threonine Metabolism Lysine Degradation Pain/Taste, or Mitochondrial Function Developmental Neurology or combinations thereof.

Additional exemplary genetic diseases or disorders and associated information are available on the world wide web at kumc.edu/gec/support, genome.gov/10001200, and ncbi.nlm.nih.gov/books/NBK22183/. Additional exemplary genetic diseases or disorders, associated genetic mutations, and gene therapy approaches to treat genetic diseases or disorders are described in International (PCT) Publication Nos. WO2013/126794, WO2013/163628, WO2015/048577, WO2015/070083, WO2015/089354, WO2015/134812, WO2015/138510, WO2015/148670, WO2015/148860, WO2015/148863, WO2015/153780, WO2015/153789, and WO2015/153791, U.S. Pat. Nos. 8,956,828, 8,383,604, 9,273,296, 8,859,597, and 9,255,130, and U.S. Patent Publication Nos. 2009/0222937, 2009/0271881, 2010/0229252, 2010/0311124, 2011/0016540, 2011/0023139, 2011/0023144, 2011/0023145, 2011/0023146, 2011/0023153, 2011/0091441, 2012/0159653, and 2013/0145487.

B. Immune Cell Engineering

It is understood that the engineered, non-naturally occurring system and CRISPR expression system disclosed herein can be used to engineer an immune cell. Immune cells include but are not limited to lymphocytes (e.g., B lymphocytes or B cells, T lymphocytes or T cells, and natural killer cells), myeloid cells (e.g., monocytes, macrophages, eosinophils, mast cells, basophils, and granulocytes), and the stem and progenitor cells that can differentiate into these cell types (e.g., hematopoietic stem cells, hematopoietic progenitor cells, and lymphoid progenitor cells). The cells can include autologous cells derived from a subject to be treated, or alternatively allogenic cells derived from a donor. Cells are treated with a non-naturally occurring CRISPR-Cas system can be treated with a system that includes a modified targeter nucleic acid, a modified modulator nucleic acid, or both, as described in sections IA, IA1, and IB. Systems that include Cas proteins such as Cas nucleases are described in section IC. RNPs, Expression systems, donor templates, efficiency and specificity, and multiplex methods are described in sections IIA, B, C, D, and E, respectively.

It is understood that the guide nucleic acid, the engineered, non-naturally occurring system, and the CRISPR expression system disclosed herein can be used to treat any disease or disorder that can be improved by editing or modifying a target sequence; exemplary genes containing target sequences to be modified for therapeutic purposes include ADORA2A, B2M, CD3E, CD38, CD40LG, CD52, CIITA, CSF2, CTLA4, DCK, FAS, HAVCR2 (also called TIM3), LAG3, PDCD1 (also called PD-1), PTPN6, TIGIT, TRAC, TRBC1, TRBC2, TRBC$_{1-2}$ (or TRBC1+2), CARD11, CD247, IL7R, LCK, PLCG1, ALPNR, BBS1, CALR, CD3G, CD58, COL17A1, DEFB134, ERAP1, ERAP2, IFNGR1, IFNGR2, JAK1, JAK2, mir-101-2, MLANA, PSMB5, PSMB8, PSMB9, PTCD2, RFX5, RFXANK, RFXAP, RPL23, SOX10, SRP54, STAT1, Tap1, TAP2, TAPBP, TWF1, CD3D, or NLRC5 gene in a cell.

In certain embodiments, the immune cell is a T cell, which can be, for example, a cultured T cell, a primary T cell, a T cell from a cultured T cell line (e.g., Jurkat, SupTi), or a T cell obtained from a mammal, for example, from a subject to be treated. If obtained from a mammal, the T cell can be obtained from numerous sources, including but not limited to blood, bone marrow, lymph node, the thymus, or other tissues or fluids. T cells can also be enriched or purified. The T cell can be any type of T cell and can be of any developmental stage, including but not limited to, CD4$^+$/CD8$^+$ double positive T cells, CD4$^+$ helper T cells (e.g., Th1 and Th2 cells), CD8$^+$ T cells (e.g., cytotoxic T cells), tumor infiltrating lymphocytes (TILs), memory T cells (e.g., central memory T cells and effector memory T cells), regulatory T cells, naive T cells, and the like.

In certain embodiments, an immune cell, e.g., a T cell, is engineered to express an exogenous gene. For example, in certain embodiments, an engineered CRISPR system disclosed herein may be used to engineer an immune cell to express an exogenous gene. For example, in certain embodiments, the guide nucleic acid, the engineered, non-naturally occurring system, and the CRISPR expression system disclosed herein may be used to engineer an immune cell to express an exogenous gene at the locus of a ADORA2A, B2M, CD3E, CD38, CD40LG, CD52, CIITA, CSF2, CTLA4, DCK, FAS, HAVCR2 (also called TIM3), LAG3, PDCD1 (also called PD-1), PTPN6, TIGIT, TRAC, TRBC1, TRBC2, TRBC$_{1-2}$ (or TRBC1+2), CARD11, CD247, IL7R, LCK, PLCG1, ALPNR, BBS1, CALR, CD3G, CD58, COL17A1, DEFB134, ERAP1, ERAP2, IFNGR1, IFNGR2, JAK1, JAK2, mir-101-2, MLANA, PSMB5, PSMB8, PSMB9, PTCD2, RFX5, RFXANK, RFXAP, RPL23, SOX10, SRP54, STAT1, Tap1, TAP2, TAPBP, TWF1, CD3D, or NLRC5 gene. For example, in certain embodiments, an engineered CRISPR system disclosed herein may catalyze DNA cleavage at a gene locus, allowing for site-specific integration of the exogenous gene at the gene locus by HDR.

In certain embodiments, an immune cell, e.g., a T cell, is engineered to express a chimeric antigen receptor (CAR), i.e., the T cell comprises an exogenous nucleotide sequence encoding a CAR. As used herein, the term "chimeric antigen receptor" or "CAR" can include any artificial receptor including an antigen-specific binding moiety and one or more signaling chains derived from an immune receptor. CARs can comprise a single chain fragment variable (scFv) of an antibody specific for an antigen coupled via hinge and transmembrane regions to cytoplasmic domains of T cell signaling molecules, e.g., a T cell costimulatory domain (e.g., from CD28, CD137, OX40, ICOS, or CD27) in tandem with a T cell triggering domain (e.g., from CD3ζ). A T cell expressing a chimeric antigen receptor is referred to as a CAR T cell. Exemplary CAR T cells include CD19 targeted CTL019 cells (see, Grupp et al. (2015) BLOOD, 126:4983), 19-28z cells (see, Park et al. (2015) J. CLIN. ONCOL., 33:7010), and KTE-C19 cells (see, Locke et al. (2015) BLOOD, 126:3991). Additional exemplary CAR T cells are described in U.S. Pat. Nos. 8,399,645, 8,906,682, 7,446,190, 9,181,527, 9,272,002, 9,266,960, 10,253,086, 10,808,035, and 10,640,569, and International (PCT) Publication Nos. WO2013/142034, WO2015/120180, WO2015/188141, WO2016/120220, and WO2017/040945. Exemplary approaches to express CARs using CRISPR systems are described in Hale et al. (2017) MOL THER METHODS CLIN DEV., 4:192, MacLeod et al. (2017) MOL THER, 25:949, and Eyquem et al. (2017) NATURE, 543:113.

In certain embodiments, an immune cell, e.g., a T cell, binds an antigen, e.g., a cancer antigen, through an endogenous T cell receptor (TCR). In certain embodiments, an immune cell, e.g., a T cell, is engineered to express an exogenous TCR, e.g., an exogenous naturally occurring TCR or an exogenous engineered TCR. T cell receptors comprise two chains referred to as the α- and β-chains, that combine on the surface of a T cell to form a heterodimeric receptor that can recognize MHC-restricted antigens. Each of α- and β-chain comprises a constant region and a variable region. Each variable region of the α- and β-chains defines three loops, referred to as complementary determining regions (CDRs) known as CDR1, CDR2, and CDR3 that confer the T cell receptor with antigen binding activity and binding specificity.

In certain embodiments, a CAR or TCR binds a cancer antigen selected from B-cell maturation antigen (BCMA), mesothelin, prostate specific membrane antigen (PSMA), prostate stem cell antigen (PCSA), carbonic anhydrase IX (CAIX), carcinoembryonic antigen (CEA), CD5, CD7, CD10, CD19, CD20, CD22, CD30, CD33, CD34, CD38, CD41, CD44, CD49f, CD56, CD70, CD74, CD123, CD133, CD138, epithelial glycoprotein2 (EGP 2), epithelial glycoprotein-40 (EGP-40), epithelial cell adhesion molecule (Ep-CAM), receptor-type tyrosine-protein kinase (FLT3), folate-binding protein (FBP), fetal acetylcholine receptor (AChR), folate receptor-a and B (FRa and B), Ganglioside G2 (GD2), Ganglioside G3 (GD3), epidermal growth factor receptor 2 (HER-2/ERB2), epidermal growth factor receptor vIII (EG-FRvIII), ERB3, ERB4, human telom erase reverse transcriptase (hTERT), Interleukin-13 receptor subunit alpha-2 (IL-13Ra2), K-light chain, kinase insert domain receptor (KDR), Lewis A (CA19.9), Lewis Y (LeY), LI cell adhesion molecule (LICAM), melanoma-associated antigen 1 (melanoma antigen family Al, MAGE-A1), Mucin 16 (MUC-16), Mucin 1 (MUC-1; e.g., a truncated MUC-1), KG2D ligands, cancer-testis antigen NY-ESO-1, oncofetal antigen (h5T4), tumor-associated glycoprotein 72 (TAG-72), vascular endothelial growth factor R2 (VEGF-R2), Wilms tumor protein (WT-1), type 1 tyrosine-protein kinase transmembrane receptor (ROR1), B7-H3 (CD276), B7-H6 (Nkp30), Chondroitin sulfate proteoglycan-4 (CSPG4), DNAX Accessory Molecule (DNAM-1), Ephrin type A Receptor 2 (EpHA2), Fibroblast Associated Protein (FAP), Gp100/HLA-A2, Glypican 3 (GPC3), HA-IH, HERK-V, IL-1 IRa, Latent Membrane Protein 1 (LMP1), Neural cell-adhesion molecule (N-CAM/CD56), and Trail Receptor (TRAIL-R).

In certain embodiments, a genetic loci suitable for insertion of a exogenous gene is intergenic. In certain embodiments, introduction of an exogenous DNA into the genetic loci meadiated by the action on a nucleic acid-guided nucleases, e.g., a cas protein bound to a suitable gNA, results in no phenotypic side affects to the host cell. In certain embodiments, the exogenous gene and or genes inserted into the genetic loci demonstrate robust transcription. In certain embodiments, the transcription of the exogenous gene or genes doesn't affect the expression of neighboring upstream or down-stream genes. In certain embodiments, robust transcription of the exogenous gene or genes in the genetic loci is maintained in progeny after proliferation of the host cell.

Genetic loci suitable for insertion of a CAR- or exogenous TCR-encoding sequence include but are not limited to safe harbor loci (e.g., the AAVS1 locus), TCR subunit loci (e.g., the TCRα constant (TRAC) locus), and other loci associated with certain advantages (e.g., the CCR5 locus, the inactivation of which may prevent or reduce HIV infection). It is understood that insertion in the TRAC locus reduces tonic CAR signaling and enhances T cell potency (see, Eyquem et al. (2017) NATURE, 543:113). Furthermore, inactivation of the endogenous TRAC gene may reduce a graft-versus-host disease (GVHD) response, thereby allowing use of allogeneic T cells as starting materials for preparation of CAR-T cells. Accordingly, in certain embodiments, an immune cell, e.g., a T cell, is engineered to have reduced expression of an endogenous TCR or TCR subunit, e.g., TCRα subunit constant (TRAC). The cell may be engineered to have partially reduced or no expression of the endogenous TCR or TCR subunit. For example, in certain embodiments, the immune cell, e.g., a T cell, is engineered to have less than 80% (e.g., less than 70%, less than 60%, less than 50%, less than 40%, less than 30%, less than 20%, less than 10%, or less than 5%) of the expression of the endogenous TCR or TCR subunit relative to a corresponding unmodified or parental cell. In certain embodiments, the immune cell, e.g., a T cell, is engineered to have no detectable expression of the endogenous TCR or TCR subunit. Exemplary approaches to reduce expression of TCRs using CRISPR systems are described in U.S. Pat. No. 9,181,527, Liu et al. (2017) CELL RES, 27:154, Ren et al. (2017) CLIN CANCER RES, 23:2255, Cooper et al. (2018) LEUKEMIA, 32:1970, and Ren et al. (2017) ONCOTARGET, 8:17002.

It is understood that certain immune cells, such as T cells, also express major histocompatibility complex (MHC) or human leukocyte antigen (HLA) genes, and inactivation of these endogenous gene may reduce a GVHD response, thereby allowing use of allogeneic T cells as starting materials for preparation of CAR-T cells. Accordingly, in certain embodiments, an immune cell, e.g., a T cell, is engineered to have reduced expression of one or more endogenous class I or class II MHCs or HLAs (e.g., beta 2-microglobulin (B2M), class II major histocompatibility complex transactivator (CIITA), HLA-E, and/or HLA-G). The cell may be engineered to have partially reduced or no expression of an endogenous MHC or HLA. For example, in certain embodiments, the immune cell, e.g., a T cell, is engineered to have less than less than 80% (e.g., less than 70%, less than 60%, less than 50%, less than 40%, less than 30%, less than 20%, less than 10%, or less than 5%) of the expression of endogenous MHC (e.g., B2M, CIITA, HLA-E, or HLA-G) relative to a corresponding unmodified or parental cell. In certain embodiments, the immune cell, e.g., a T cell, is engineered to have no detectable expression of an endogenous MHC (e.g., B2M, CIITA, HLA-E, or HLA-G). Exemplary approaches to reduce expression of MHCs using CRISPR systems are described in Liu et al. (2017) CELL RES, 27:154, Ren et al. (2017) CLIN CANCER RES, 23:2255, and Ren et al. (2017) ONCOTARGET, 8:17002.

Other genes that may be inactivated to reduce a GVHD response include but are not limited to CD3, CD52, and deoxycytidine kinase (DCK). For example, inactivation of DCK may render the immune cells (e.g., T cells) resistant to purine nucleotide analogue (PNA) compounds, which are often used to compromise the host immune system in order to reduce a GVHD response during an immune cell therapy. In certain embodiments, the immune cell, e.g., a T cell, is engineered to have less than less than 80% (e.g., less than 70%, less than 60%, less than 50%, less than 40%, less than 30%, less than 20%, less than 10%, or less than 5%) of the expression of endogenous CD52 or DCK relative to a corresponding unmodified or parental cell.

In certain embodiments, an immune cell, e.g., a T cell, is engineered to have reduced expression of an endogenous gene. For example, in certain embodiments, an engineered CRISPR system disclosed herein may be used to engineer an immune cell to have reduced expression of an endogenous gene. For example, in certain embodiments, an engineered CRISPR system disclosed herein may result in DNA cleavage at a gene locus, thereby inactivating the targeted gene. In other embodiments, an engineered CRISPR system disclosed herein may be fused to an effector domain (e.g., a transcriptional repressor or histone methylase) to reduce the expression of the target gene.

It is understood that the activity of an immune cell (e.g., T cell) may be enhanced by inactivating or reducing the expression of an immune suppressor such as an immune checkpoint protein. Accordingly, in certain embodiments, an immune cell, e.g., a T cell, is engineered to have reduced expression of an immune checkpoint protein. Exemplary immune checkpoint proteins expressed by wild-type T cells include but are not limited to PDCD1 (PD-1), CSF2, CTLA4, ADORA2A (A2AR), B7-H3, B7-H4, BTLA, KIR, LAG3, HAVCR2 (TIM3), TIGIT, VISTA, PTPN6 (SHP-1), and FAS. The cell may be modified to have partially reduced or no expression of the immune checkpoint protein. For example, in certain embodiments, the immune cell, e.g., a T cell, is engineered to have less than 80% (e.g., less than 70%, less than 60%, less than 50%, less than 40%, less than 30%, less than 20%, less than 10%, or less than 5%) of the expression of the immune checkpoint protein relative to a corresponding unmodified or parental cell. In certain embodiments, the immune cell, e.g., a T cell, is engineered to have no detectable expression of the immune checkpoint protein. Exemplary approaches to reduce expression of immune checkpoint proteins using CRISPR systems are described in International (PCT) Publication No. WO2017/017184, Cooper et al. (2018) LEUKEMIA, 32:1970, Su et al. (2016) ONCOIMMUNOLOGY, 6: e1249558, and Zhang et al. (2017) FRONT MED, 11:554.

The immune cell can also be engineered to express an exogenous protein (besides an antigen-binding protein described above) at the locus of a human ADORA2A, B2M, CD3E, CD38, CD40LG, CD52, CIITA, CSF2, CTLA4, DCK, FAS, HAVCR2 (also called TIM3), LAG3, PDCD1 (also called PD-1), PTPN6, TIGIT, TRAC, TRBC1, TRBC2, $TRBC_{1-2}$ (or TRBC1+2), CARD11, CD247, IL7R, LCK, PLCG1, ALPNR, BBS1, CALR, CD3G, CD58, COL17A1, DEFB134, ERAP1, ERAP2, IFNGR1, IFNGR2, JAK1, JAK2, mir-101-2, MLANA, PSMB5, PSMB8, PSMB9, PTCD2, RFX5, RFXANK, RFXAP, RPL23, SOX10, SRP54, STAT1, Tap1, TAP2, TAPBP, TWF1, CD3D, or NLRC5 gene.

In certain embodiments, an immune cell, e.g., a T cell, is modified to express a dominant-negative form of an immune checkpoint protein. In certain embodiments, the dominant-negative form of the checkpoint inhibitor can act as a decoy receptor to bind or otherwise sequester the natural ligand that would otherwise bind and activate the wild-type immune checkpoint protein. Examples of engineered immune cells, for example, T cells containing dominant-negative forms of an immune suppressor are described, for example, in International (PCT) Publication No. WO2017/040945.

In certain embodiments, an immune cell, e.g., a T cell, is modified to express a gene (e.g., a transcription factor, a cytokine, or an enzyme) that regulates the survival, proliferation, activity, or differentiation (e.g., into a memory cell) of the immune cell. In certain embodiments, the immune cell is modified to express TET2, FOXO1, IL-12, IL-15, IL-18, IL-21, IL-7, GLUT1, GLUT3, HK1, HK2, GAPDH, LDHA, PDK1, PKM2, PFKFB3, PGK1, ENO1, GYS1, and/or ALDOA. In certain embodiments, the modification is an insertion of a nucleotide sequence encoding the protein operably linked to a regulatory element. In certain embodiments, the modification is a substitution of a single nucleotide polymorphism (SNP) site in the endogenous gene. In certain embodiments, an immune cell, e.g., a T cell, is modified to express a variant of a gene, for example, a variant that has greater activity than the respective wild-type gene. In certain embodiments, the immune cell is modified to express a variant of CARD11, CD247, IL7R, LCK, or PLCG1. For example, certain gain-of-function variants of IL7R were disclosed in Zenatti et al., (2011) NAT. GENET. 43 (10): 932-39. The variant can be expressed from the native locus of the respective wild-type gene by delivering an engineered system described herein for targeting the native locus in combination with a donor template that carries the variant or a portion thereof.

In certain embodiments, an immune cell, e.g., a T cell, is modified to express a protein (e.g., a cytokine or an enzyme) that regulates the microenvironment that the immune cell is designed to migrate to (e.g., a tumor microenvironment). In certain embodiments, the immune cell is modified to express CA9, CA12, a V-ATPase subunit, NHE1, and/or MCT-1.

In certain embodiments, provided is a method for treatment of a disease, e.g., a cancer, by administering to a subject suffering from the disease an effective amount of T cells modified to express a CAR specific to the disease using the modified guide nucleic acids and CRISPR-Cas systems described herein, e.g., in sections IA, IA1, IB, IC, and IVB. In certain embodiments, the T cells are autologous cells removed from the subject, treated to modify genomic DNA to express CAR, expanded, and administered to the subject; in certain embodiments, the T cells are allogeneic T cells that have been treated to modify genomic DNA to express CAR. In certain embodiments, the disease is a blood cancer, such as leukemia or lymphoma; in certain embodiments the disease is a solid tumor cancer.

V. KITS

It is understood that the engineered, non-naturally occurring system, the CRISPR expression system, and/or the library disclosed herein can be packaged in a kit suitable for use by a medical provider, researcher, and the like. Accordingly, in another aspect, the invention provides kits containing any one or more of the elements disclosed in the above systems, libraries, methods, and compositions. In certain embodiments, the kit comprises an engineered, non-naturally occurring system as disclosed herein and instructions for using the kit. The instructions may be specific to the applications and methods described herein. In certain embodiments, one or more of the elements of the system are provided in a solution. In certain embodiments, one or more of the elements of the system are provided in lyophilized form, and the kit further comprises a diluent. Elements may be provided individually or in combinations, and may be provided in any suitable container, such as a vial, a bottle, a tube, or immobilized on the surface of a solid base (e.g., chip or microarray). In certain embodiments, the kit comprises one or more of the nucleic acids and/or proteins described herein. In certain embodiments, the kit provides all elements of the systems of the invention.

In certain embodiments of a kit comprising the engineered, non-naturally occurring system, the targeter nucleic acid and the modulator nucleic acid, where one or more nucleotides at or near the 3' and/or 5' end of either or both, is modified, are provided in separate containers. In other embodiments, the targeter nucleic acid and the modulator nucleic acid are pre-complexed, and the complex is provided in a single container. In certain embodiments, the kit comprises a Cas protein or a nucleic acid comprising a regulatory element operably linked to a nucleic acid encoding a Cas protein provided in a separate container. In other embodiments, the kit comprises a Cas protein pre-complexed with the targeter nucleic acid and the modulator nucleic acid, and the complex is provided in a single container.

In order to target multiple target nucleotide sequences, e.g., for use in a screening or selection process, a kit may be provided comprising multiple targeter nucleic acids. Accordingly, in certain embodiments, the kit comprises a plurality of targeter nucleic acids as disclosed herein (e.g., in separate tubes or immobilized on the surface of a solid base such as a chip or a microarray), optionally one or more modulator nucleic acids as disclosed herein, and optionally a Cas protein or a regulatory element operably linked to a nucleic acid encoding a Cas protein as disclosed herein. Such kits are useful for identifying a targeter nucleic acid with the highest efficiency and/or specificity to target a given gene, for identifying a gene implicated in a physiological or pathological pathway, or for engineering a cell to achieve desired functionality in a multiplex assay. In certain embodiments, the kit further comprises one or more donor templates provided in one or more separate containers. In certain embodiments, the kit comprises a plurality of donor templates as disclosed herein (e.g., in separate tubes or immobilized on the surface of a solid base such as a chip or a microarray), one or more targeter nucleic acids disclosed herein, and one or more modulator nucleic acids as disclosed herein, and optionally a Cas protein or a regulatory element operably linked to a nucleic acid encoding a Cas protein as disclosed herein. Such kits are useful for identifying a donor template that introduces optimal genetic modification in a multiplex assay. The CRISPR expression systems as disclosed herein are also suitable for use in a kit.

In certain embodiments, a kit further comprises one or more reagents and/or buffers for use in a process utilizing one or more of the elements described herein. Reagents may be provided in any suitable container and may be provided in a form that is usable in a particular assay, or in a form that requires addition of one or more other components before use (e.g., in concentrate or lyophilized form). A buffer may be a reaction or storage buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In certain embodiments, the buffer has a pH from 6-9, 6.5-8.5, 7-8, 6.5-7.5, 6-8, 7.5-8.5, 7-9, 6.5-9.5, 6-10, 8-9, 7.5-9.5, 7-10, for example 7-8, such as 7.5. In certain embodiments, the kit further comprises a pharmaceutically acceptable carrier. In certain embodiments, the kit further comprises one or more devices or other materials for administration to a subject.

Throughout the description, where compositions are described as having, including, or comprising specific components, or where processes and methods are described as having, including, or comprising specific steps, it is contemplated that, additionally, there are compositions of the present invention that consist essentially of, or consist of, the recited components, and that there are processes and methods according to the present invention that consist essentially of, or consist of, the recited processing steps.

In the application, where an element or component is said to be included in and/or selected from a list of recited elements or components, it should be understood that the element or component can be any one of the recited elements or components, or the element or component can be selected from a group consisting of two or more of the recited elements or components.

Further, it should be understood that elements and/or features of a composition or a method described herein can be combined in a variety of ways without departing from the spirit and scope of the present invention, whether explicit or implicit herein. For example, where reference is made to a particular compound, that compound can be used in various embodiments of compositions of the present invention and/or in methods of the present invention, unless otherwise understood from the context. In other words, within this application, embodiments have been described and depicted in a way that enables a clear and concise application to be written and drawn, but it is intended and will be appreciated that embodiments may be variously combined or separated without parting from the present teachings and invention(s). For example, it will be appreciated that all features described and depicted herein can be applicable to all aspects of the invention(s) described and depicted herein.

The terms "a" and "an" and "the" and similar references in the context of describing the invention (especially in the context of the following claims) are to be construed to cover both the singular and the plural, unless otherwise indicated herein or clearly contradicted by context. For example, the term "a cell" can include a plurality of cells, including mixtures thereof. Where the plural form is used for compounds, salts, and the like, this is taken to mean also a single compound, salt, or the like.

It should be understood that the expression "at least one of" includes individually each of the recited objects after the expression and the various combinations of two or more of the recited objects unless otherwise understood from the context and use. The expression "and/or" in connection with three or more recited objects should be understood to have the same meaning unless otherwise understood from the context.

The use of the term "include," "includes," "including," "have," "has," "having," "contain," "contains," or "containing," including grammatical equivalents thereof, should be understood generally as open-ended and non-limiting, for example, not excluding additional unrecited elements or steps, unless otherwise specifically stated or understood from the context.

Where the use of the term "about" is before a quantitative value, the present invention also includes the specific quantitative value itself, unless specifically stated otherwise. As used herein, the term "about" refers to a +10% variation from the nominal value unless otherwise indicated or inferred.

It should be understood that the order of steps or order for performing certain actions is immaterial so long as the present invention remain operable. Moreover, two or more steps or actions may be conducted simultaneously.

The use of any and all examples, or exemplary language herein, for example, "such as" or "including," is intended merely to illustrate better the present invention and does not pose a limitation on the scope of the invention unless claimed. No language in the specification should be construed as indicating any non-claimed element as essential to the practice of the present invention.

VI. EMBODIMENTS

In embodiment 1 provided herein is a composition comprising a synthetic guide nucleic acid (gNA) comprising (i) a targeter nucleic acid comprising: (a) a spacer sequence configured to hybridize with a target nucleotide sequence, and (b) a targeter stem sequence; and (ii) a modulator nucleic acid comprising (a) a modulator stem sequence complementary to the targeter stem sequence, and (b) a 5' sequence; wherein either the targeter nucleic acid or the modulator nucleic acid, or both, comprise one or more modified nucleotides at or near its 3' end, if present, at or near its 5' end, if present, or both. In embodiment 2 provided herein is the composition of embodiment 1 wherein the synthetic gNA is a single polynucleotide. In embodiment 3 provided herein is the composition of embodiment 1 wherein the targeter nucleic acid and the modulator nucleic acid are separate nucleic acids. In embodiment 4 provided herein is the composition of any one of embodiments 1 through 3 wherein some or all of the gNA is RNA, e.g provided herein is a gRNA. In embodiment 5 provided herein is the composition of embodiment 4 wherein at least 50% of the nucleic acid is RNA. In embodiment 6 provided herein is the composition of embodiment 4 wherein at least 70% of the nucleic acid is RNA. In embodiment 7 provided herein is the composition of embodiment 4 wherein at least 90% of the nucleic acid is RNA. In embodiment 8 provided herein is the composition of embodiment 4 wherein at least 100% of the nucleic acid is RNA. In embodiment 9 provided herein is the composition of any one of embodiments 1 through 8 wherein the modified nucleotide comprises a chemical modification. In embodiment 10 provided herein is the composition of any one of embodiments 1 through 9 wherein the stem sequences are between one and ten nucleotides in length. In embodiment 11 provided herein is the composition of any one of embodiments 1 through 9 wherein the stem sequences are between two and nice nucleotides in length. In embodiment 12 provided herein is the composition of any one of embodiments 1 through 9 wherein the stem sequences are between four and six nucleotides in length. In embodiment 13 provided herein is the composition of any one of embodiments 1 through 12 wherein the stem sequences of the modulator and targeter nucleic acids share at least 80% sequence complementarity. In embodiment 14 provided herein is the composition of any one of embodiments 1 through 12 wherein the stem sequences of the modulator and targeter nucleic acids share at least 90% sequence complementarity. In embodiment 15 provided herein is the composition of any one of embodiments 1 through 12 wherein the stem sequences of the modulator and targeter nucleic acids share at least 95% sequence complementarity. In embodiment 16 provided herein is the composition of any one of embodiments 1 through 12 wherein the stem sequences of the modulator and targeter nucleic acids share 100% sequence complementarity. In embodiment 17 provided herein is the composition of embodiment 2 wherein the modification comprises a chemical modification in one or more nucleotides or internucleotide linkages at or near the 5' end of the gNA. In embodiment 18 provided herein is the composition of embodiment 17 wherein the chemical modification comprises a chemical modification in at least one nucleotide or internucleotide linkage within ten nucleotides of the 5' end. In embodiment 19 provided herein is the composition of embodiment 17 wherein the chemical modification comprises one to 17 phosphorothioate modifications within 17 internucleotide linkages of the 5' end. In embodiment 20 provided herein is the composition of embodiment 19 wherein the chemical modification comprises one to ten phopshorothioate modifications within ten internucleotide linkages of the 5' end. In embodiment 21 provided herein is the composition of embodiment 19 wherein the chemical modification comprises nine phosphorothioate modifications to the final nine internucleotide linkages of the 5' end. In embodiment 22 provided herein is the composition of embodiment 17 wherein the chemical modification comprises one to five 2'-O-methoxy modifications to one or more nucleotides within five nucleotides of the 5' end. In embodiment 23 provided herein is the composition of any one of embodiments 17 through 21 wherein the chemical modification comprises two 2'-O-methoxy modifications to the final two nucleotides of the 5' end. In embodiment 24 provided herein is the composition of any one of embodiments 17 through 21 wherein the chemical modification comprises one 2'-O-methoxy modification to the 5' terminal nucleotide. In embodiment 25 provided herein is the composition of any one of embodiments 17 through 24 wherein the chemical modification comprises a propanediol modification to the 5' terminal nucleotide. In embodiment 26 provided herein is the composition of embodiment 17 wherein the modulator nucleic acid comprises any one of SEQ ID NOs: 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, or 1037. In embodiment 27 provided herein is the composition of embodiment 2 wherein the modification comprises a chemical modification in one or more nucleotides or internucleotide linkages at or near the 3' end of the gNA. In embodiment 28 provided herein is the composition of any one of embodiments 17 through 25 wherein the chemical modification further comprises a chemical modification in one or more nucleotides or internucleotide linkages at or near the 3' end of the gNA. In embodiment 29 provided herein is the composition of embodiment 27 or embodiment 28 wherein the chemical modification comprises a chemical modification in at least one nucleotide or internucleotide linkage within ten nucleotides of the 3' end. In embodiment 30 provided herein is the composition of embodiment 27 or embodiment 28 wherein the chemical modification comprises one to 17 phosphorothioate modifications within 17 internucleotide linkages of the 3' end. In embodiment 31 provided herein is the composition of embodiment 30 wherein the chemical modification comprises one to ten phopshorothioate modifications within ten internucleotide linkages of the 3' end. In embodiment 32 provided herein is the composition of embodiment 30 wherein the chemical modification comprises nine phosphorothioate modifications to the final nine internucleotide linkages of the 3' end. In embodiment 33 provided herein is the composition of any one of embodiments 27 through 32 wherein the chemical modification comprises one to five 2'-O-methoxy modifications to one or more nucleotides within five nucleotides of the 3' end. In embodiment 34 provided herein is the composition of any one of embodiments 27 through 32 wherein the chemical modification comprises two 2'-O-methoxy modifications to the final two nucleotides of the 3' end. In embodiment 35 provided herein is the composition of any one of embodiments 27 through 32 wherein the chemical modification comprises one 2'-O-methoxy modification to the last nucleotide of the 3' end. In embodiment 36 provided herein is the composition of any one of embodiments 27 through 35 wherein the chemical modification comprises a propanediol modification to the 3' terminal nucleotide. In embodiment 37 provided herein is the composition of embodiment 3 wherein the modulator nucleic acid is unmodified. In embodiment 38 provided herein is the composition of embodiment 3 wherein the modification comprises a chemical modification in one or more nucleotides or internucleotide linkages at or near the 5' end of the modulator nucleic acid. In embodiment 39 provided herein is the composition of embodiment 38 wherein the chemical modification comprises a chemical modification in at least one nucleotide or internucleotide linkage within ten nucleotides of the 5' end. In embodiment 40 provided herein is the composition of embodiment 38 wherein the chemical modification comprises one to 17 phosphorothioate modifications within 17 internucleotide linkages of the 5' end. In embodiment 41 provided herein is the composition of embodiment 40 wherein the chemical modification comprises one to ten phopshorothioate modifications within ten internucleotide linkages of the 5' end. In embodiment 42 provided herein is the composition of embodiment 40 wherein the chemical modification comprises nine phosphorothioate modifications to the final nine internucleotide linkages of the 5' end. In embodiment 43 provided herein is the composition of any one of embodiments 38 through 42 wherein the chemical modification comprises one to five 2'-O-methoxy modifications to one or more nucleotides within five nucleotides of the 5' end. In embodiment 44 provided herein is the composition of any one of embodiments 38 through 42 wherein the chemical modification comprises two 2'-O-methoxy modifications to the final two nucleotides of the 5' end. In embodiment 45 provided herein is the composition of any one of embodiments 38 through 42 wherein the chemical modification comprises one 2'-O-methoxy modification to the 5' end nucleotide. In embodiment 46 provided herein is the composition of any one of embodiments 38 through 45 wherein the chemical modification comprises a propanediol modification to the 5' terminal nucleotide. In embodiment 47 provided herein is the composition of embodiment 38 wherein the modulator nucleic acid comprises any one of SEQ ID NOs: 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, or 1037. In embodiment 48 provided herein is the composition of any one of embodiments 3 and embodiments 38 through 46 wherein the modification comprises a chemical modification to one or more nucleotides or internucleotide linkages at or near the 3' end of the modulator nucleic acid. In embodiment 49 provided herein is the composition of embodiment 48 wherein the chemical modification comprises a chemical modification in at least one nucleotide or internucleotide linkage within ten nucleotides of the 3' end. In embodiment 50 provided herein is the composition of embodiment 48 wherein the chemical modification comprises one1 to 17 phosphorothioate modifications within 17 internucleotide linkages of the 3' end. In embodiment 51 provided herein is the composition of embodiment 50 wherein the chemical modification comprises one to ten phopshorothioate modifications within ten internucleotide linkages of the 3' end. In embodiment 52 provided herein is the composition of embodiment 50 wherein the chemical modification comprises nine phosphorothioate modifications to the final nine internucleotide linkages of the 3' end. In embodiment 53 provided herein is the composition of any one of embodiments 3 and embodiments 38 through 52 wherein the chemical modification comprises one to five 2'-O-methoxy modifications to one or more nucleotides within five nucleotides of the 3' end. In embodiment 54 provided herein is the composition of any one of embodiments 3 and embodiments 38 through 52 wherein the chemical modification comprises two 2'-O-methoxy modifications to the final two nucleotides of the 3' end. In embodiment 55 provided herein is the composition of any one of embodiments 3 and embodiments 38 through 52 wherein the chemical modification comprises one 2'-O-methoxy modification to the last nucleotide of the 3' end. In embodiment 56 provided herein is the composition of any one of embodiments 48 through 55 wherein the chemical modification comprises a propanediol modification to the 3' terminal nucleotide. In embodiment 57 provided herein is the composition of any one of embodiments 3 and 38 through 56 wherein the targeter nucleic acid is unmodified. In embodiment 58 provided herein is the composition of any one of embodiments 37 through 56 wherein the chemical modification comprises a chemical modification in one or more nucleotides or internucleotide linkages at or near the 3' end of the targeter nucleic acid. In embodiment 59 provided herein is the composition of embodiment 58 wherein the chemical modification comprises a chemical modification in at least one nucleotide or internucleotide linkage within ten nucleotides of the 3' end. In embodiment 60 provided herein is the composition of embodiment 58 wherein the chemical modification comprises one to five 2'-O-methoxy-3'-phosphorothioate modifications within five nucleotides of the 3' end. In embodiment 61 provided herein is the composition of embodiment 58 wherein the chemical modification comprises two 2'-O-methoxy-3'-phosphorothioate modifications to the final two nucleotides of the 3' end. In embodiment 62 provided herein is the composition of embodiment 58 wherein the chemical modification comprises one through nine 2'-fluoro modifications to the final nine nucleotides of the 3' end. In embodiment 63 provided herein is the composition of embodiment 58 wherein the chemical modification comprises five 2'-fluoro modifications to the final five nucleotides of the 3' end. In embodiment 64 provided herein is the composition of any one of embodiments 58 through 63 wherein the chemical modification comprises a propanediol modification to the 3' terminal nucleotide. In embodiment 65 provided herein is the composition of any one of embodiments 3, embodiments 37 through 56, and embodiments 58 through 64 wherein the modification comprises a chemical modification at or near the 5' end of the targeter nucleic acid. In embodiment 66 provided herein is the composition of embodiment 65 wherein the chemical modification comprises a chemical modification in at least one nucleotide or internucleotide linkage within ten nucleotides of the 5' end. In embodiment 67 provided herein is the composition of embodiment 65 wherein the chemical modification comprises one to five 2'-O-methoxy-3'-phosphorothioate modifications within five nucleotides of the 5' end. In embodiment 68 provided herein is the composition of embodiment 65 wherein the chemical modification comprises two 2'-O-methoxy-3'-phosphorothioate modifications to the final two nucleotides of the 5' end. In embodiment 69 provided herein is the composition of embodiment 65 wherein the chemical modification comprises one through nine 2'-fluoro modifications to one or more nucleotides within nine nucleotides of the 5' end. In embodiment 70 provided herein is the composition of embodiment 65 wherein the chemical modification comprises five 2'-fluoro modification to the final five nucleotides of the 5' end. In embodiment 71 provided herein is the composition of any one of embodiments 65 through 70 wherein the chemical modification comprises a propanediol modification to the 5' terminal nucleotide. In embodiment 72 provided herein is the composition of embodiment 1, 9, 17, 18, 27, 28, 29, 38, 39, 48, 49, 58, 59, or 65 wherein the chemical modification is 2'-O-alkyl, 2'-O-methyl, a phosphorothioate, a phosphonoacetate, a thiophosphonoacetate, a 2'-O-methyl-3'-phosphorothioate, a 2'-O-methyl-3'-phosphonoacetate, a 2'-O-methyl-3'-thiophosphonoacetate, a 2'-deoxy-3'-phosphonoacetate, a 2'-deoxy-3'-thiophosphonoacetate, or a combination thereof. In embodiment 73 provided herein is a composition comprising a Cas nuclease complexed with a gNA of any of the previous embodiments. In embodiment 74 provided herein is the composition of embodiment 73 wherein the Cas nuclease comprises a Type V Cas nuclease. In embodiment 75 provided herein is the composition of embodiment 74, wherein the Cas nuclease comprises a type V-A, type V-C, or type V-D Cas nuclease. In embodiment 76 provided herein is the composition of embodiment 75, wherein the Cas nuclease comprises a type V-A Cas nuclease. In embodiment 77 provided herein is the composition of embodiment 76 wherein the Type V-A Cas nuclease comprises a MAD, Csm1, ART, ABW, or other Cpf1 nuclease, or derivative or variant thereof. In embodiment 78 provided herein is the composition of embodiment 77 wherein the nuclease comprises a sequence with at least 80% identity to any one of SEQ ID NOs: 3, 4, 5, 6, 7, 8, 9, 10, or 11. In embodiment 79 provided herein is the composition of embodiment 77 wherein the nuclease comprises a sequence with at least 80% identity to any one of SEQ ID NOs: 1 or 2. In embodiment 80 provided herein is the composition of embodiment 77 wherein the nuclease comprises a sequence with at least 80% identity to any one of SEQ ID NOs: 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980, 981, 982, 983, or 984. In embodiment 81 provided herein is the composition of embodiment 77 wherein the nuclease comprises a sequence with at least 80% identity to any one of SEQ ID NOs: 789, 16, 29, 42, 55, 68, 81, 94, or 107. In embodiment 82 provided herein is the composition of any one of embodiments 78 through 81 wherein the nuclease sequence is at least 85% identical to the sequence. In embodiment 83 provided herein is the composition of any one of embodiments 78 through 81 wherein the nuclease sequence is at least 90% identical to the sequence. In embodiment 84 provided herein is the composition of any one of embodiments 78 through 81 wherein the nuclease sequence is at least 95% identical to the sequence. In embodiment 85 provided herein is the composition of any one of embodiments 78 through 81 wherein the nuclease sequence is at least 97.5% identical to the sequence. In embodiment 86 provided herein is the composition of any one of embodiments 78 through 81 wherein the nuclease sequence is 100% identical to the sequence. In embodiment 87 provided herein is the composition of any one of embodiments 1 through 71 wherein the spacer sequence comprises a sequence capable of hybridizing with a target nucleotide sequence within a human ADORA2A, B2M, CD3E, CD38, CD40LG, CD52, CIITA, CSF2, CTLA4, DCK, FAS, HAVCR2 (also called TIM3), LAG3, PDCD1 (also called PD-1), PTPN6, TIGIT, TRAC, TRBC1, TRBC2, $TRBC_{1-2}$ (or TRBC1+2), CARD11, CD247, IL7R, LCK, PLCG1, ALPNR, BBS1, CALR, CD3G, CD58, COL17A1, DEFB134, ERAP1, ERAP2, IFNGR1, IFNGR2, JAK1, JAK2, mir-101-2, MLANA, PSMB5, PSMB8, PSMB9, PTCD2, RFX5, RFXANK, RFXAP, RPL23, SOX10, SRP54, STAT1, Tap1, TAP2, TAPBP, TWF1, CD3D, or NLRC5 gene. In embodiment 88 provided herein is the composition of any one of embodiments 1 through 71 wherein the spacer sequence comprises a sequence capable of hybridizing with a target nucleotide sequence within a safe harbor site. In embodiment 89 provided herein is the composition of any one of embodiments 3 and 37 through 71 wherein the dual gNA when complexed with a Cas nuclease as an RNP results in at least 70% of the editing efficiency as compared to a 5' and 3' propanediol modified single gNA. In embodiment 90 provided herein is the composition of any one of embodiments 3 and 37 through 71 wherein the dual gNA when complexed with a Cas nuclease as an RNP results in at least 80% of the editing efficiency as compared to a 5' and 3' propanediol modified single gNA. In embodiment 91 provided herein is the composition of any one of embodiments 3 and 37 through 71 wherein the dual gNA when complexed with a Cas nuclease as an RNP results in at least 90% of the editing efficiency as compared to a 5' and 3' propanediol modified single gNA. In embodiment 92 provided herein is the composition of any one of embodiments 3 and 37 through 71 wherein the dual gNA when complexed with a Cas nuclease as an RNP results in the same editing efficiency as compared to a single 5' and 3' propanediol modified gNA. In embodiment 93 provided herein is the composition of any one of embodiments 3 and 37 through 71 wherein the modified gNA when complexed with a Cas nuclease as an RNP results in higher editing efficiency as compared to a single gNA. In embodiment 94 provided herein is a eukaryotic cell comprising the gRNA of any of embodiments 1 through 71. In embodiment 95 provided herein is a eukaryotic cell comprising the nucleic acid-guided nuclease complex of any of embodiments 73 through 86. In embodiment 96 provided herein is the composition of embodiment 94 or embodiment 95 wherein the eukaryotic cell is an allogeneic cell. In embodiment 97 provided herein is the composition of any one of embodiments 94 through 96 wherein the eukaryotic cell is an immune cell. In embodiment 98 provided herein is the composition of embodiment 97 wherein the immune cell is a human immune cell. In embodiment 99 provided herein is the composition of embodiment 97 wherein the immune cell comprises a neutrophil, an eosinophil, a basophil, a mast cell, a monocyte, a macrophage, a dendritic cell, a natural killer cell, or a lymphocyte. In embodiment 100 provided herein is the composition of embodiment 97 wherein the immune cell is a T cell. In embodiment 101 provided herein is the composition of embodiment 97 wherein the immune cell is a CAR T cell. In embodiment 102 provided herein is the composition of any one of embodiments 94 through 96 wherein the eukaryotic cell is a stem cell. In embodiment 103 provided herein is the composition of embodiment 102 wherein the stem cell is a human pluripotent stem cell. In embodiment 104 provided herein is the composition of embodiment 102 wherein the stem cell is an embryonic stem cell or an induced pluripotent stem cell. In embodiment 105 provided herein is the composition of embodiment 102 wherein the stem cell is a hematopoietic stem cell. In embodiment 106 provided herein is a method of cleaving a target DNA having a target nucleotide sequence, the method comprising contacting the target DNA with the composition of any one of embodiments 73 through 86, thereby resulting in cleavage of the target DNA. In embodiment 107 provided herein is the method of embodiment 106, wherein the contacting occurs in vitro. In embodiment 108 provided herein is the method of embodiment 106, wherein the contacting occurs in a cell ex vivo. In embodiment 109 provided herein is the method of embodiment 108, wherein the target DNA is genomic DNA of the cell. In embodiment 110 provided herein is the method of embodiment 108, wherein the system is delivered into the cell as a pre-formed RNP complex. In embodiment 111 provided herein is the method of embodiment 110, wherein the pre-formed RNP complex is delivered into the cell by electroporation, lipofection, or a viral method. In embodiment 112 provided herein is the method of embodiment 111 wherein the pre-formed RNP complex is delivered into the cell by electroporation. In embodiment 113 provided herein is a method of editing the genome of a eukaryotic cell, the method comprising delivering the engineered, non-naturally occurring system of any one of embodiments 73 through 86, or components thereof and/or one or more polynucleotides coding for one or more components thereof, into the eukaryotic cell, thereby resulting in editing of the genome of the eukaryotic cell. In embodiment 114 provided herein is the method of embodiment 113, wherein the system is delivered into the cell as a pre-formed RNP complex. In embodiment 115 provided herein is the method of embodiment 113 or 114, wherein the system is delivered into the cell by electroporation, lipofection, or a viral method. In embodiment 116 provided herein is the method of embodiment 113 or 114, wherein the system is delivered into the cell by electroporation. In embodiment 117 provided herein is the method of any one of embodiments 113 through 116, wherein the cell is an immune cell. In embodiment 118 provided herein is the method of embodiment 117, wherein the immune cell is a neutrophil, eosinophil, basophil, mast cell, monocyte, macrophage, dendritic cell, natural killer cell, or a lymphocyte. In embodiment 119 provided herein is the method of embodiment 117, wherein the immune cell is a T lymphocyte. In embodiment 120 provided herein is the method of embodiment 119, wherein an exogenous donor template is delivered in addition to the RNP wherein the donor template is used to repair the cleaved target DNA. In embodiment 121 provided herein is the method of embodiment 120 wherein the exogenous donor template is CAR cassette. In embodiment 122 provided herein is the composition of a CAR T cell resulting from the method of embodiment 121. In embodiment 123 provided herein is the method of embodiment 113 wherein the engineered, non-naturally occurring system is delivered to a plurality of eukaryotic cells, and wherein the system comprises a guide nucleic acid comprising one or modifications as described herein, wherein the editing efficiency of the genomes of the plurality of cells is increased by at least 5% compared to the editing efficiency when the same system but without the modification or modifications is used. In embodiment 124 provided herein is a pharmaceutical composition comprising the composition of any one of embodiments 1 through 93 and a pharmaceutically acceptable carrier. In embodiment 125 provided herein is a method of treating a disease or a disorder comprising administering to a subject in need thereof an effective amount of a composition of any one of embodiments 1 through 93, or an effective amount of cells modified by treatment with a composition of any one of embodiments 1 through 93. In embodiment 126 provided herein is the method of embodiment 125 comprising administering to a subject in need thereof of cells modified by treatment with a composition of any one of embodiment 1 to 93. In embodiment 127 provided herein is the method of embodiment 125 wherein the cells are cells that are removed from an individual and treated ex vivo with a composition of any one of embodiment 1 to 93. In embodiment 128 provided herein is the method of embodiment 127 wherein the subject in need of treatment and the individual whose cells are treated ex vivo are the same. In embodiment 129 provided herein is a composition comprising the composition of any one of embodiments 1 through 72 further comprising a Cas protein. In embodiment 130 provided herein is the composition of embodiment 128 wherein the Cas protein is a Cas nuclease. In embodiment 131 provided herein is the composition of embodiment 130 wherein the Cas nuclease is a Type I, II, III, IV, V, or VI Cas nuclease. In embodiment 132 provided herein is the composition of embodiment 131 wherein the Cas nuclease is a Type II Cas nuclease.

VII. EXAMPLES

Example 1

In this Example various combinations of modified and unmodified modulator and targeter nucleic acids were used with a Cas nuclease and the editing efficiency for each combination was evaluated.

Figure 2A:
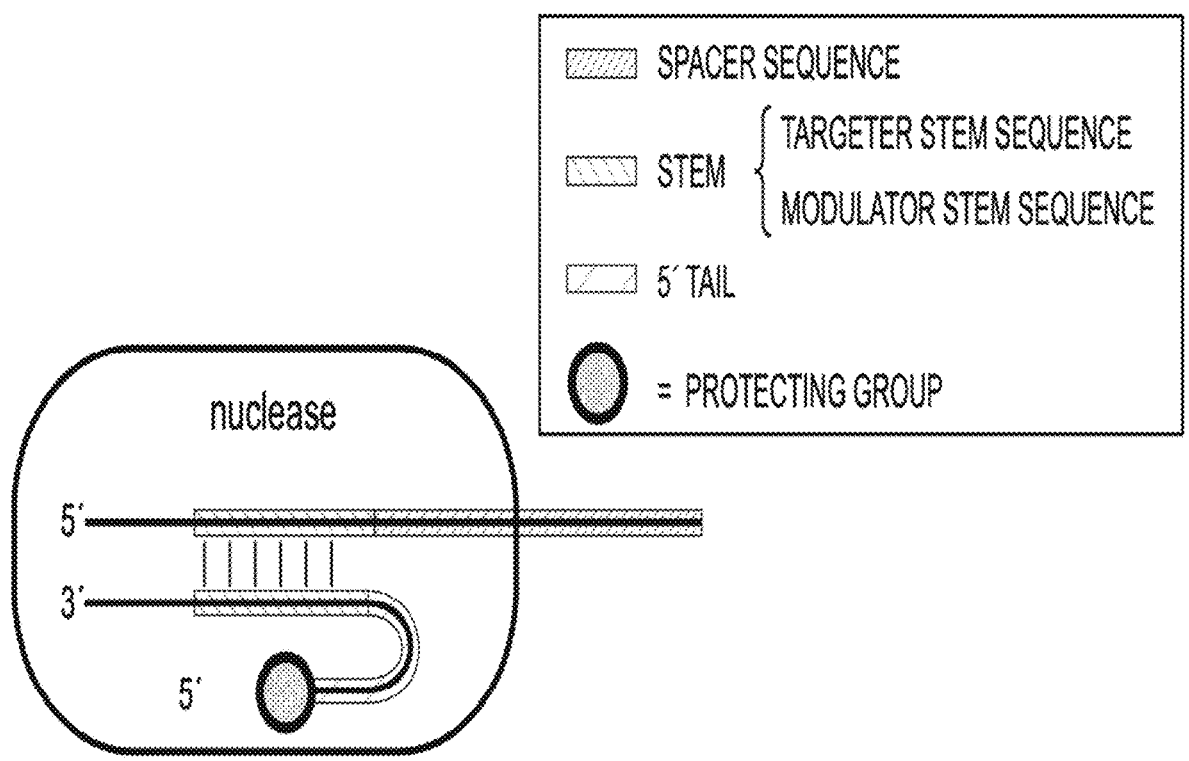
FIG. 2A-2C show a series of schematic representations of exemplary modifications to dual guide gRNA. 2A: protecting group at 5' end of modulator nucleic acid; 2B: donor template recruiting sequence at 5' end of modulator nucleic acid; 2C: editing enhancer at 5' end of modulator nucleic acid.
Figure 2B:
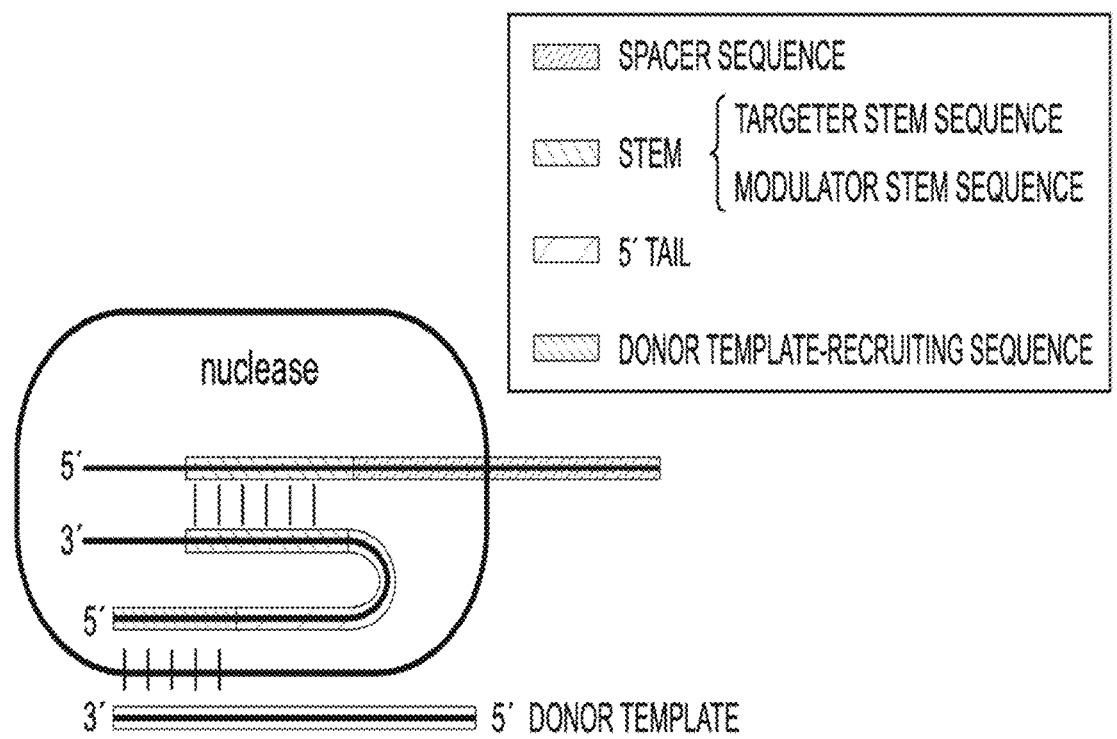
Figure 2C:
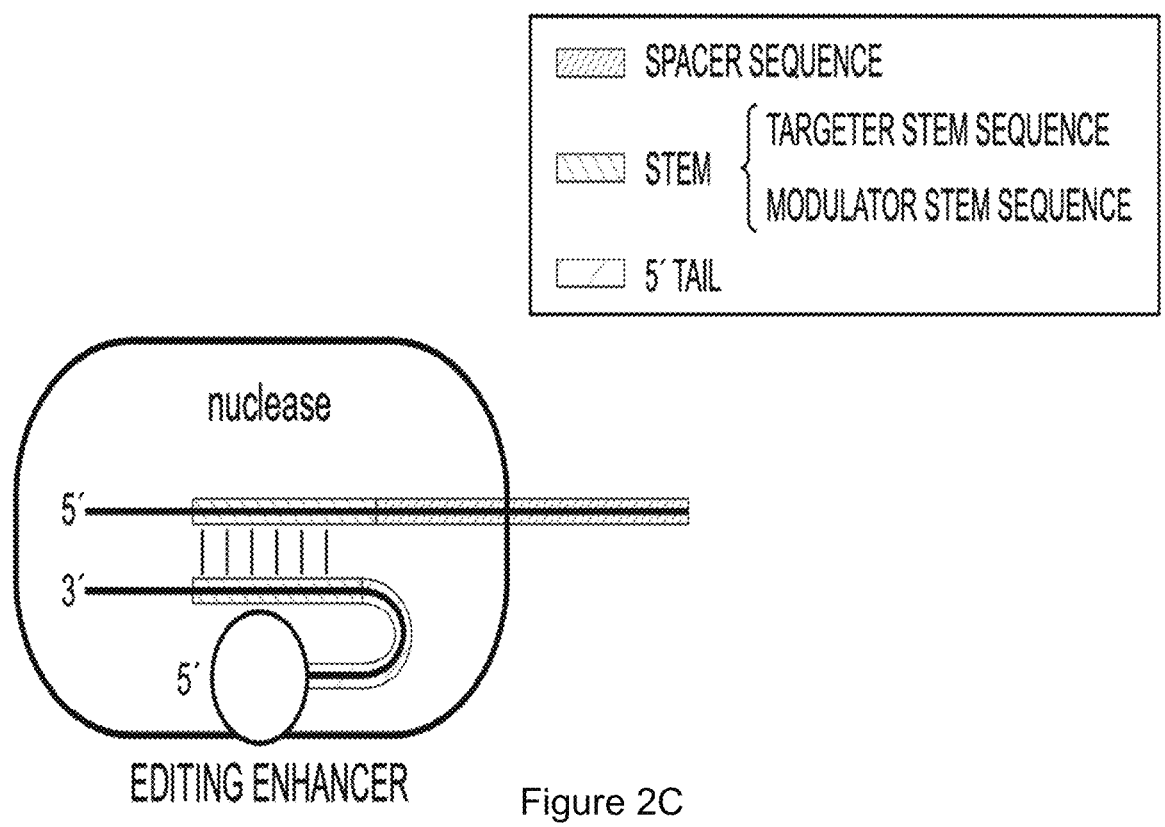

Modifications included at least one of 2'-O-methyl (M), a phosphorothioate(S), a phosphonoacetate (P), a thio-phosphonoacetate (SP), a 2'-O-methyl-3'-phosphorothioate (MS), a 2'-O-methyl-3'-phosphonoacetate (MP), a 2'-O-methyl-3'-thiophosphonoacetate (MSP), a 2'-deoxy-3'-phosphonoacetate (DP), a 2'-deoxy-3'-thiophosphonoacetate (DSP), propanediol (Alt-R) or a combination thereof at either the 3' or 5' end. The modified/unmodified crRNA and tracrRNA (sequences shown in Table 27) were mixed in the molar ratio 1:1 (200 pmol+200 pmol) at room temperature and incubated for 15 min. For the formation of the RNPs 100 pmol unmodified/modified gRNA were mixed with 100 pmol Mad7 nuclease and transfected into primary Pan T cells using the Lonza nucleofector system. Combinations of modifications tested are shown in FIG. 2.

Figure 3:
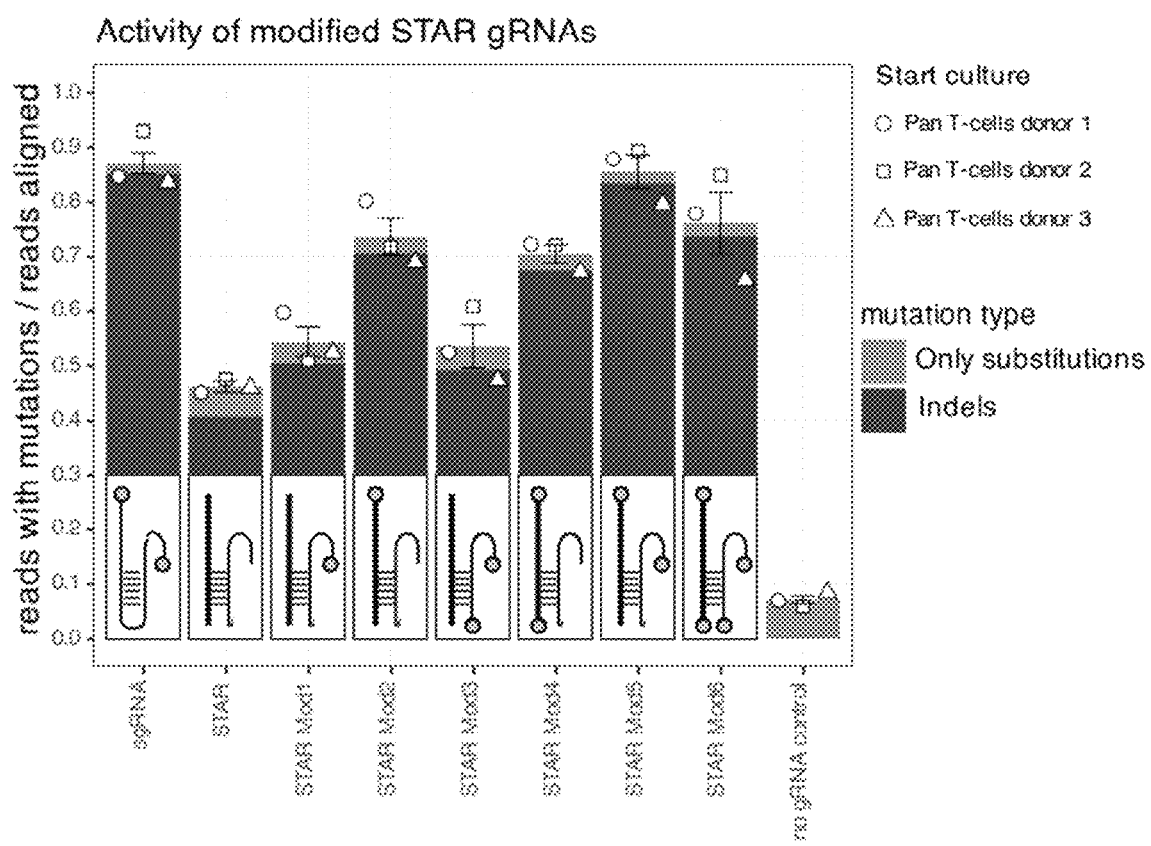
FIG. 3 shows data for editing efficiency (as measured by # of reads modified/total # of reads) in primary T cells in an exon of an exemplary gene 1. Shown are editing results relative to the single gRNA design (left bar) vs. the negative control (far right bar).

FIG. 3 shows data for editing efficiency (as measured by # of reads modified/total # of reads) in primary T cells in an exon at a gene locus. The gRNA designs are shown and show the various combination of modifications tested at either the 3' and/or the 5' end of the crRNA or tracrRNA. Sequences for each tested modification are shown in Table 27. The Figure shows the editing results relative to the single gRNA design (left bar) vs. the negative control (far right bar). It is observed that the modifications made to the crRNA make a much larger difference than the tracrRNA although the combination of dual modified crRNA and tracrRNA make the greatest increase in editing efficiency.

TABLE 27

Modified Single and Dual gRNAs

| Name | Description | SEQ ID NO | Sequence[1] |
|---|---|---|---|
| sgRNA | — | 1038 | /AltR1/TAATTTCTACTCTTGTAGATGAGTCTCTCAGCTGGTACACG/AltR2/ |
| STAR | Modulator | 1039 | TAATTTCTACTC |
| | Targeter | 1040 | TTGTAGATGAGTCTCTCAGCTGGTACACG |
| STAR MOD1 | Modulator | 1041 | /AltR1/TAATTTCTACTC |
| | Targeter | 1042 | TTGTAGATGAGTCTCTCAGCTGGTACACG |

TABLE 27-continued

Modified Single and Dual gRNAs

| Name | Description | SEQ ID NO | Sequence[1] |
|---|---|---|---|
| STAR MOD2 | Modulator | 1043 | TAATTTCTACTC |
| | Targeter | 1044 | TTGTAGATGAGTCTCTCAGCTGGTACACG/AltR2/ |
| STAR MOD3 | Modulator | 1045 | /AltR1/TAATTTCTACTC/AltR2/ |
| | Targeter | 1046 | TTGTAGATGAGTCTCTCAGCTGGTACACG |
| STAR MOD4 | Modulator | 1047 | TAATTTCTACTC |
| | Targeter | 1048 | /AltR1/TTGTAGATGAGTCTCTCAGCTGGTACACG/AltR2/ |
| STAR MOD5 | Modulator | 1049 | /AltR1/TAATTTCTACTC |
| | Targeter | 1050 | TTGTAGATGAGTCTCTCAGCTGGTACACG/AltR2/ |
| STAR MOD6 | Modulator | 1051 | /AltR1/TAATTTCTACTC/AltR2/ |
| | Targeter | 1052 | /AltR1/TTGTAGATGAGTCTCTCAGCTGGTACACG/AltR2/ |

[1]/AltR1/ indiciated a sequence modified with a 5' Alt-R (propanediol) modification.
/AltR2/ indicates a sequence modified with a 3' Alt-R (propanediol) modification.

Example 2

In this Example various combinations of modified and unmodified modulator and targeter nucleic acids were used with a Cas nuclease and the editing efficiency for each combination was evaluated for three gene targets (Gene 1, Gene 2, Gene 3).

Modifications included at least one of 2'-O-methyl (M), a phosphorothioate(S), a phosphonoacetate (P), a thio-phosphonoacetate (SP), a 2'-O-methyl-3'-phosphorothioate (MS), a 2'-O-methyl-3'-phosphonoacetate (MP), a 2'-O-methyl-3'-thiophosphonoacetate (MSP), a 2'-deoxy-3'-phosphonoacetate (DP), a 2'-deoxy-3'-thiophosphonoacetate (DSP), a 2'-fluoro-ribonucleotide, propanediol (Alt-R) or a combination thereof at either the 3' or 5' end. The modified/unmodified crRNA and tracrRNA were mixed in the molar ratio 1:1 (200 pmol+200 pmol) at room temperature and incubated for 15 min. For the formation of the RNPs 100 pmol unmodified/modified gRNA were mixed with 100 pmol Mad7 nuclease and transfected into primary Pan T cells using the Lonza nucleofector system. Sequences for each modulator nucleic acid and targeter nucleic acid used in the study with their respective modifications are shown in Table 28 and Table 29.

The specific sequence for each modulator and targeter complex in FIGS. 4-6 may be deduced using the naming convention (modulator description) x (targeter description) using Table 28 and Table 29. For example, an experimental test using complex Mod_A_7_x_Tar_1 for gene 3 would comprise a modulator of SEQ ID NO: 1031 and a targeter of SEQ ID NO: 1008. It is observed that some combinations made to the modulator-targeter complex demonstrate activity greater than the sgRNA. It is also observed that some combinations made to the modulator-targeter complex demonstrate lower but sufficient (greater than or equal to 70% activity) activity compared to the sgRNA.

Figure 4A:
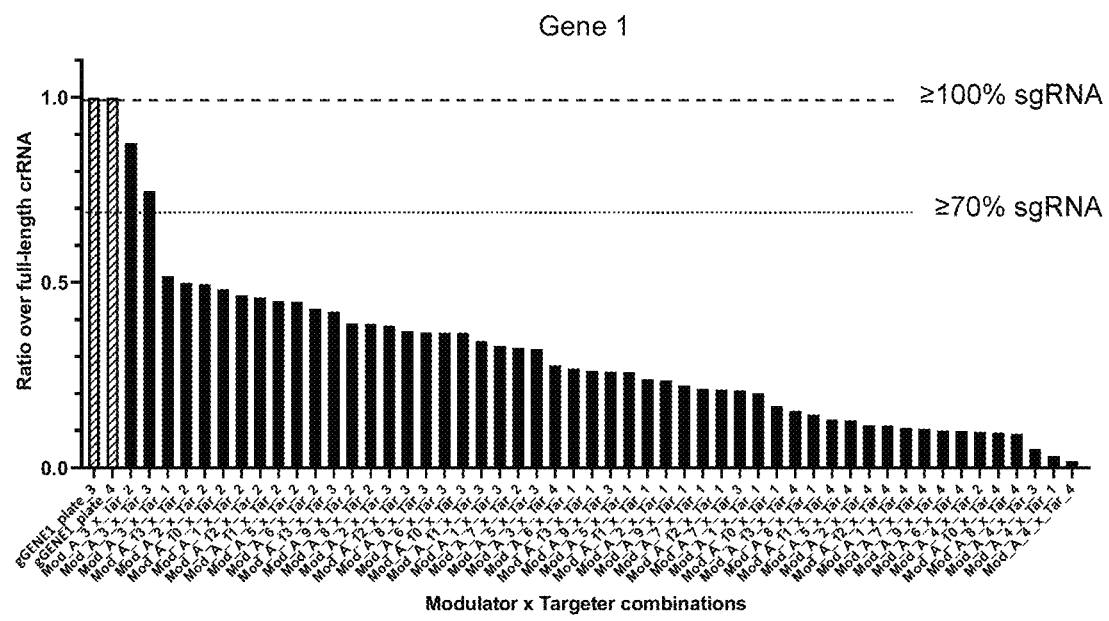
FIG. 4A shows a series of data for editing efficiency in primary T cells in an exon of an exemplary gene 1. Shown are editing results of multiple modified gRNA designs over the single gRNA design (2 right bars).
Figure 4B:
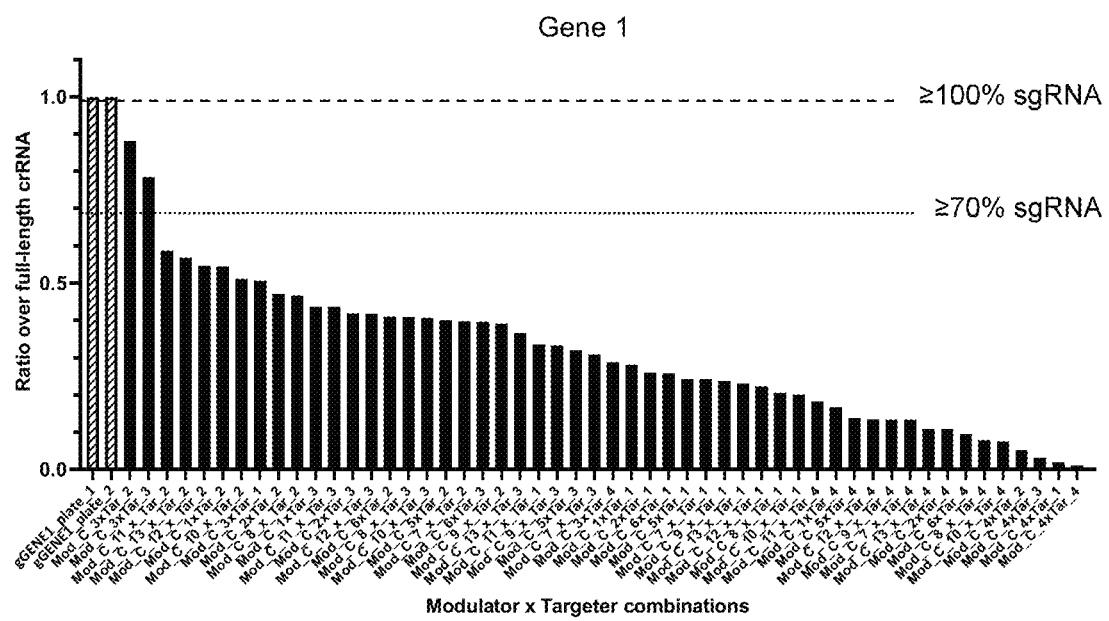
FIG. 4B shows a series of data for editing efficiency in primary T cells in an exon of an exemplary gene 1. Shown are editing results of multiple modified gRNA designs over the single gRNA design (2 right bars).

FIGS. 4A and B show data for the editing efficiency (as measured by # of reads modified/total # of reads) in primary T cells in an exon at a gene locus for gene 1 for dual gRNAs. Each tested gNA is shown on the x-axis with the first two representing single gRNA controls. The editing efficiency for each tested dual gRNA is normalized to the activity of the single gRNA control. The dotted line represents an editing efficiency of 70% relative to the single gRNA control. The dashed line represents an editing efficiency equal to the single gRNA control. FIG. 4A shows normalized editing efficiencies for dual guide RNAs comprising modulator nucleic acids with a terminal 3′ A nucleotide. Control gRNAs for FIG. 4A are SEQ ID NO: 1056. FIG. 4B shows normalized editing efficiencies for dual guide RNAs comprising modulator nucleic acids with a terminal 3′ C nucleotide. Control RNAs for FIG. 4B are SEQ ID NO: 1055.

Figure 5A:
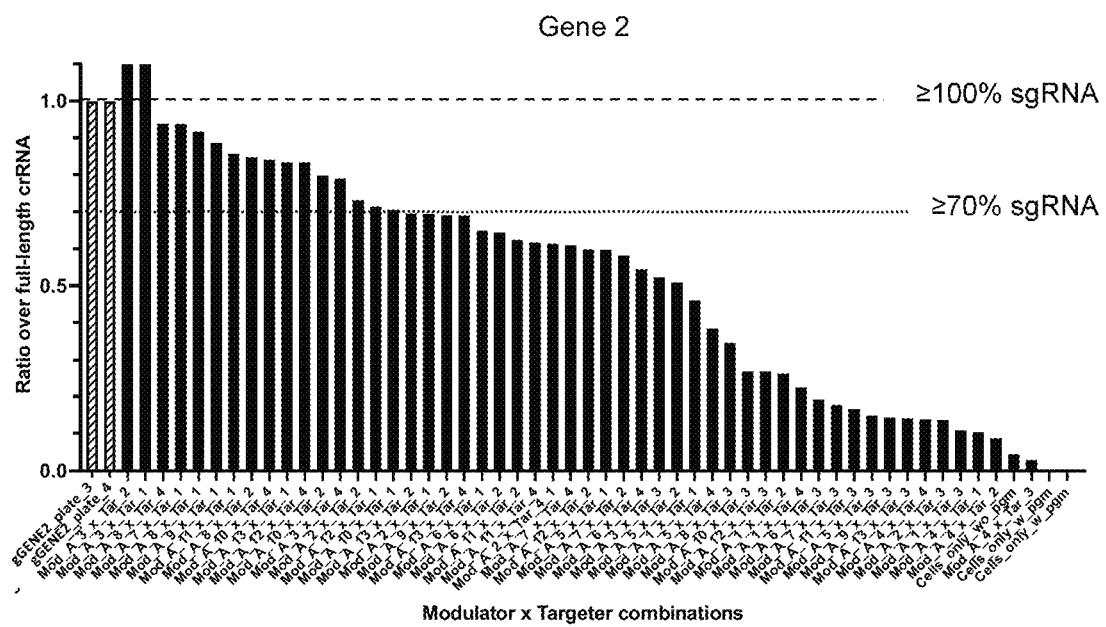
FIG. 5A shows a series of data for editing efficiency in primary T cells in an exon of an exemplary gene 2. Shown are editing results of multiple modified gRNA designs over the single gRNA design (2 right bars).
Figure 5B:
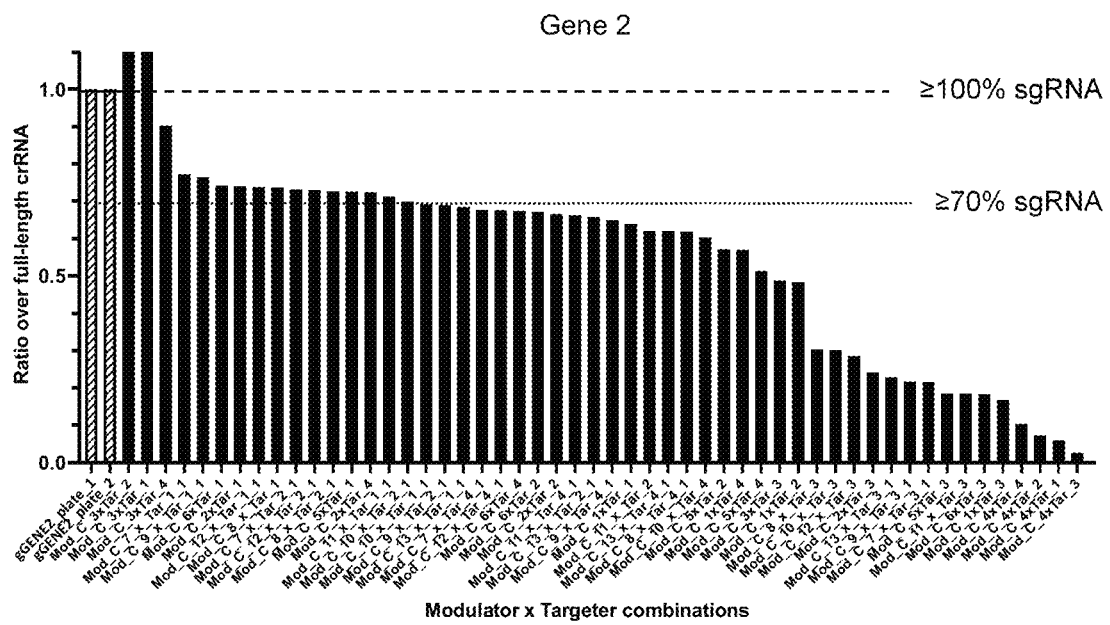
FIG. 5B shows a series of data for editing efficiency in primary T cells in an exon of an exemplary gene 2. Shown are editing results of multiple modified gRNA designs over the single gRNA design (2 right bars).

FIGS. 5A and B show data for the editing efficiency (as measured by # of reads modified/total # of reads) in primary T cells in an exon at a gene locus for gene 2 for dual gRNAs. Each tested gNA is shown on the x-axis with the first two representing single gRNA controls. The editing efficiency for each tested dual gRNA is normalized to the activity of the single gRNA control. The dotted line represents an editing efficiency of 70% relative to the single gRNA control. The dashed line represents an editing efficiency equal to the single gRNA control. FIG. 5A shows normalized editing efficiencies for dual guide RNAs comprising modulator nucleic acids with a terminal 3′ A nucleotide. Control RNAs for FIG. 5A are SEQ ID NO: 1058. FIG. 5B shows normalized editing efficiencies for dual guide RNAs comprising modulator nucleic acids with a terminal 3′ C nucleotide. Control RNAs for FIG. 5B are SEQ ID NO: 1057.

Figure 6A:
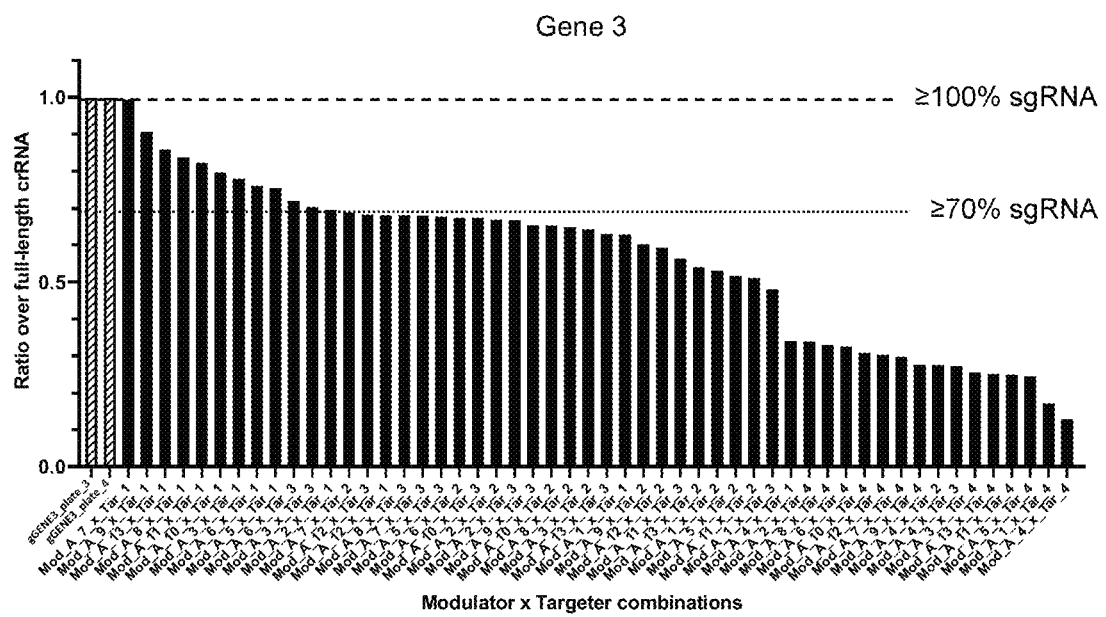
FIG. 6A shows a series of data for editing efficiency in primary T cells in an exon of an exemplary gene 3. Shown are editing results of multiple modified gRNA designs over the single gRNA design (2 right bars).
Figure 6B:
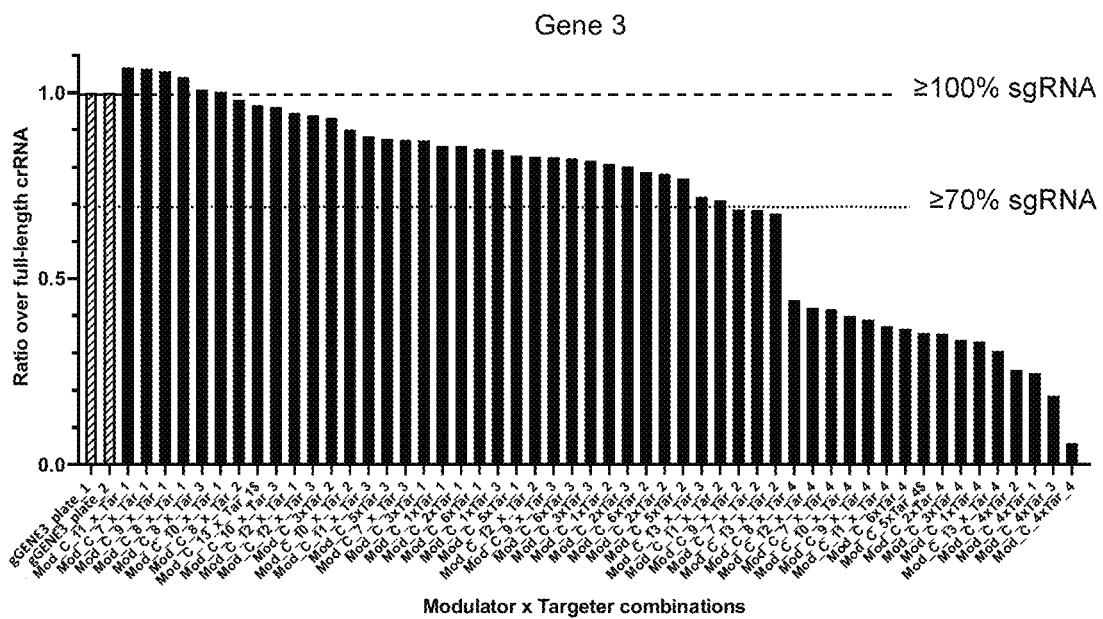
FIG. 6B shows a series of data for editing efficiency in primary T cells in an exon of an exemplary gene 3. Shown are editing results of multiple modified gRNA designs over the single gRNA design (2 right bars).

FIGS. 6A and B show data for the editing efficiency (as measured by # of reads modified/total # of reads) in primary T cells in an exon at a gene locus for gene 3 for dual gRNAs. Each tested gNA is shown on the x-axis with the first two representing single gRNA controls. The editing efficiency for each tested dual gRNA is normalized to the activity of the single gRNA control. The dotted line represents an editing efficiency of 70% relative to the single gRNA control. The dashed line represents an editing efficiency equal to the single gRNA control. FIG. 6A shows normalized editing efficiencies for dual guide RNAs comprising modulator nucleic acids with a terminal 3′ A nucleotide. Control RNAs for FIG. 6A are SEQ ID NO: 1054. FIG. 6B shows normalized editing efficiencies for dual guide RNAs comprising modulator nucleic acids with a terminal 3′ C nucleotide. Control RNAs for FIG. 6B are SEQ ID NO: 1053.

TABLE 28

Targeter Sequences

| SEQ ID NO | Description | Sequence[1] |
|---|---|---|
| 1000 | Tar_1_gene_2 | TTGTAGATCACAGGAGCCGACCTGCCTAC |
| 1001 | Tar_2_gene_2 | TTGTAGATCACAGGAGCCGACCTGCCTAC/AltR2/ |
| 1002 | Tar_3_gene_2 | TTGTAGATCACAGGAGCCGACCTGCCT*mA*mC |
| 1003 | Tar_4_gene_2 | TTGTAGATCACAGGAGCCGACCTG/i2FC//i2FC//i2FT//i2FA//i2FC/ |
| 1004 | Tar_1_gene_1 | TTGTAGATCAAGGACTTCAGCTGGGGGAA |

TABLE 28-continued

Targeter Sequences

| SEQ ID NO | Description | Sequence[1] |
|---|---|---|
| 1005 | Tar_2_gene_1 | TTGTAGATCAAGGACTTCAGCTGGGGGAA/AltR2/ |
| 1006 | Tar_3_gene_1 | TTGTAGATCAAGGACTTCAGCTGGGGG*mA*mA |
| 1007 | Tar_4_gene_1 | TTGTAGATCAAGGACTTCAGCTGG/i2FG//i2FG//i2FG//i2FA//i2FA/ |
| 1008 | Tar_1_gene_3 | TTGTAGATGAGTCTCTCAGCTGGTACACG |
| 1009 | Tar_2_gene_3 | TTGTAGATGAGTCTCTCAGCTGGTACACG/AltR2/ |
| 1010 | Tar_3_gene_3 | TTGTAGATGAGTCTCTCAGCTGGTACA*mC*mG |
| 1011 | Tar_4_gene_3 | TTGTAGATGAGTCTCTCAGCTGGT/i2FA//i2FC//i2FA//i2FC//i2FG/ |

[1]m indicates a 2-O-methoxy phosphorothioate nucleotide modification.
*indicates a phosphorothioate internucleotide linkage modification.
/i2FN/ indicates a 2′-fluoro nucleotide modification where the N may comprise any base (A, T, G, or C).
/AltR2/ indicates a sequence modified with a 3′ Alt-R (propanediol) modification as shown in FIG. 7B.

TABLE 29

Modulator Sequences

| SEQ ID NO | Description | Sequences[1] |
|---|---|---|
| 1012 | STAR_MOD_C_1 | TAATTTCTACTC |
| 1013 | STAR_MOD_C_2 | /Alt1/TAATTTCTACTC |
| 1014 | STAR_MOD_C_3 | mT*A*TAATTTCTACTC |
| 1015 | STAR_MOD_C_4 | mT*mA*TAATTTCTACTC |
| 1016 | STAR_MOD_C_5 | AGACCTTTTTAATTTCTACTC |
| 1017 | STAR_MOD_C_6 | /Alt1/AGACCTTTTTAATTTCTACTC |
| 1018 | STAR_MOD_C_7 | A*G*A*C*C*T*T*T*T*TAATTTCTACTC |
| 1019 | STAR_MOD_C_8 | mA*mG*ACCTTTTTAATTTCTACTC |
| 1020 | STAR_MOD_C_9 | mA*G*ACCTTTTTAATTTCTACTC |
| 1021 | STAR_MOD_C_10 | GTCAAAAGACCTTTTTAATTTCTACTC |
| 1022 | STAR_MOD_C_11 | /Alt1/GTCAAAAGACCTTTTTAATTTCTACTC |
| 1023 | STAR_MOD_C_12 | mG*mT*CAAAAGACCTTTTTAATTTCTACTC |
| 1024 | STAR_MOD_C_13 | mG*T*CAAAAGACCTTTTTAATTTCTACTC |
| 1025 | STAR_MOD_A_1 | TAATTTCTACTA |
| 1026 | STAR_MOD_A_2 | /Alt1/TAATTTCTACTA |
| 1027 | STAR_MOD_A_3 | mT*A*TAATTTCTAGTA |

TABLE 29-continued

Modulator Sequences

| SEQ ID NO | Description | Sequences[1] |
|---|---|---|
| 1028 | STAR_MOD_A_4 | mT*mA*TAATTTCTACTA |
| 1029 | STAR_MOD_A_5 | AGACCTTTTTAATTTCTACTA |
| 1030 | STAR_MOD_A_6 | /Alt1/AGACCTTTTTAATTTCTACTA |
| 1031 | STAR_MOD_A_7 | A*G*A*C*C*T*T*T*T*TAATTTCTACTA |
| 1032 | STAR_MOD_A_8 | mA*mG*ACCTTTTTAATTTCTACTA |
| 1033 | STAR_MOD_A_9 | mA*G*ACCTTTTTAATTTCTACTA |
| 1034 | STAR_MOD_A_10 | GTCAAAAGACCTTTTTAATTTCTACTA |
| 1035 | STAR_MOD_A_11 | /Alt1/GTCAAAAGACCTTTTTAATTTCTACTA |
| 1036 | STAR_MOD_A_12 | mG*mT*CAAAAGACCTTTTTAATTTCTACTA |
| 1037 | STAR_MOD_A_13 | mG*T*CAAAAGACCTTTTTAATTTCTACTA |

[1]m indicates a 2-O-methoxy phosphorothioate nucleotide modification.
*indicates a phosphorothioate internucleotide linkage modification.
/Alt1/ indicates a sequence modified a 5' Alt-R (propanediol) modification as shown in FIG. 7A.

TABLE 30

Control Sequences

| SEQ ID NO | Description | Sequences[1] |
|---|---|---|
| 1053 | gGENE3_plate_1 and gGENE3_plate_2 | /AltR1/TAATTTCTACTCTTGTAGATGAGTCTCTCAGCTGGTACACG/AltR2/ |
| 1054 | gGENE3_plate_3 and gGENE3_plate_4 | /AltR1/TAATTTCTACTATTGTAGATGAGTCTCTCAGCTGGTACACG/AltR2/ |
| 1055 | gGENE1_plate_2 | /AltR1/TAATTTCTACTCTTGTAGATCAAGGACTTCAGCTGGGGGAA/AltR2/ |
| 1056 | gGENE1_plate_3 and gGENE1_plate_4 | /AltR1/TAATTTCTACTATTGTAGATCAAGGACTTCAGCTGGGGGAA/AltR2/ |
| 1057 | gGENE2_plate_1 and gGENE2_plate_2 | /AltR1/TAATTTCTACTCTTGTAGATCACAGGAGCCGACCTGCCTAC/AltR2/ |
| 1058 | gGENE2_plate_3 and gGENE2_plate_4 | /AltR1/TAATTTCTACTATTGTAGATCACCAGGAGCCGACCTGCTAC/AltR2/ |

Example 3

In this example, various combinations of modified and unmodified modulator and targeter nucleic acids targeting the B2M gene were used with a Cas nuclease. For each combination, the editing efficiency and surface expression of HLA-1 was evaluated.

Modifications included at least one of 2'-O-methyl (M), a phosphorothioate(S), a phosphonoacetate (P), a thiophosphonoacetate (SP), a 2'-O-methyl-3'-phosphorothioate (MS), a 2'-O-methyl-3'-phosphonoacetate (MP), a 2'-O-methyl-3'-thiophosphonoacetate (MSP), a 2'-deoxy-3'-phosphonoacetate (DP), a 2'-deoxy-3'-thiophosphonoacetate (DSP), a 2'-fluoro-ribonucleotide, propanediol (Alt-R) or a combination thereof at either the 3' or 5' end. The modified/unmodified crRNA and tracrRNA were mixed in the molar ratio 1:1 (200 pmol+200 pmol) at room temperature and incubated for 15 min. For the formation of the RNPs 100 pmol unmodified/modified gRNA were mixed with 100 pmol Mad7 nuclease and transfected into primary Pan T cells using the Lonza nucleofector system. Sequences for each modulator nucleic acid and targeter nucleic acid used in the study with their respective modifications are shown in Table 31 and Table 29.

Figure 7:
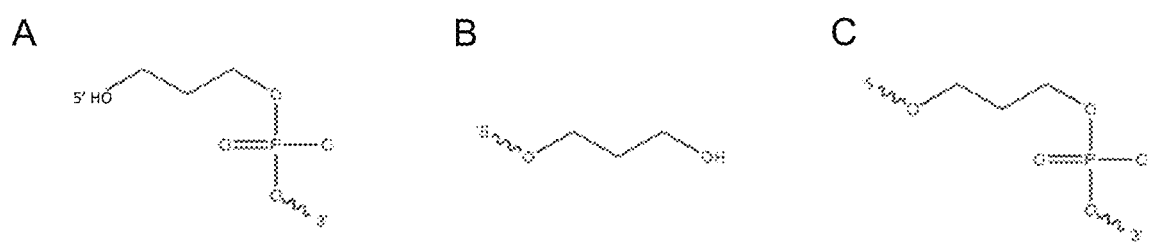
FIG. 7 shows chemical structures for a 5' (panel A), 3' (panel B), and internal (panel C) propanediol modification.
Figure 8:
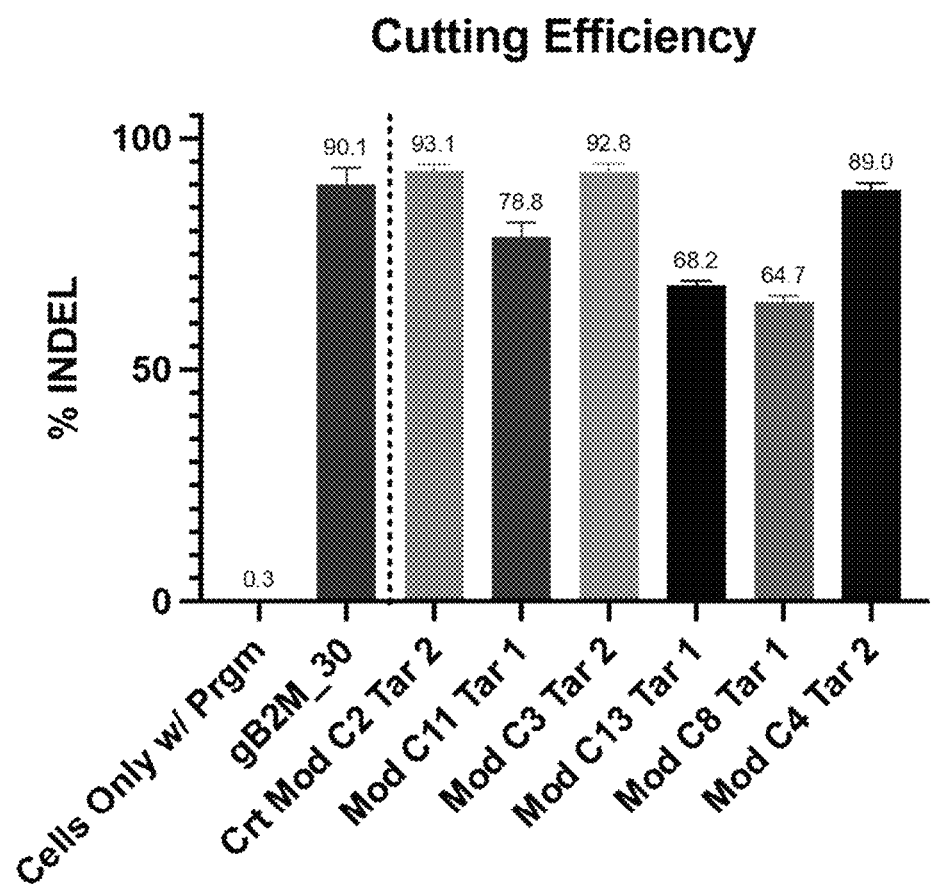
FIG. 8 shows editing efficiency in primary T cells in a B2M gene. Shown are the editing results of multiple modified gRNA designs over the single gRNA design.
Figure 9:
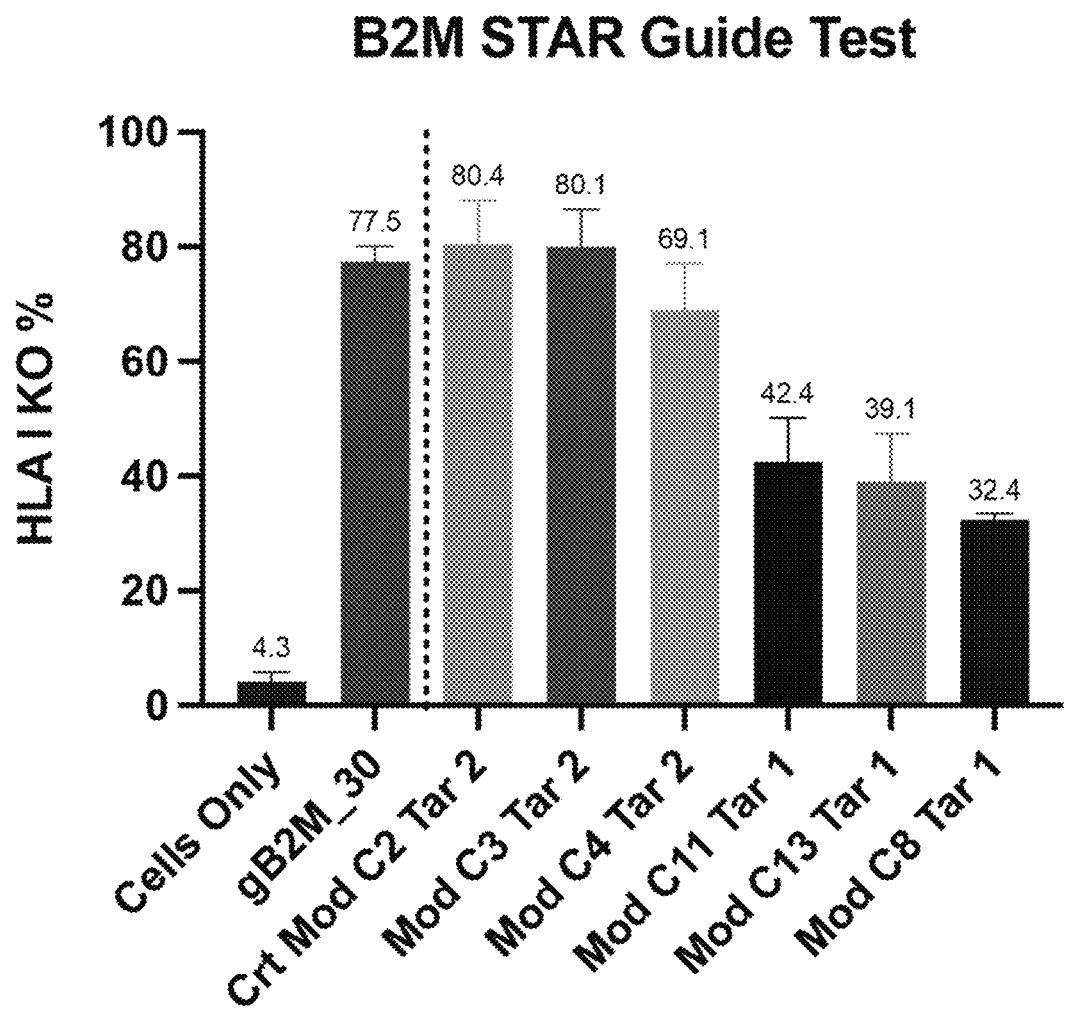
FIG. 9 shows HLA-1 surface expression knock down after treatment with RNP comprising multiple modified gRNA design compared to the single gRNA design targeting the B2M gene as measured by flow cytometry.

The specific sequence for each modulator and targeter complex in FIGS. 7-8 may be deduced using the naming convention (modulator description) (targeter description) using Table 31 and Table 29. For example, an experimental test using complex Mod C2 Tar 2 would comprise a modulator comprising SEQ ID NO: 1013 and a targeter comprising SEQ ID NO: 999. It is observed that some combinations made to the modulator-targeter complex demonstrate activity greater than the sgRNA. It is observed that some combinations made to the modulator-targeter complex demonstrate activity similar to the sgRNA. It is also observed that some combinations made to the modulator-targeter complex demonstrate lower but sufficient activity compared to the sgRNA.

FIG. 7 show data for the editing efficiency at the B2M gene (as measured by % INDELs formed) in primary T cells after treatment with various combinations of modified and unmodified modulator and targeter nucleic acids complexed with MAD7. INDEL formation was measured by amplicon sequencing of the gene post treatment. Each tested gNA is shown on the x-axis with the first two representing a no gRNA and single gRNA controls, respectively. INDEL formation as a percentage of total reads is shown on the y-axis.

FIG. 8 show data for the editing efficiency and resultant reduction in HLA-1 surface expression in primary T cells as measured by flow cytometry (proportion of cells lacking HLA-1 expression in the population) after treatment with various combinations of modified and unmodified modulator and targeter nucleic acids complexed with MAD7. Each tested gNA is shown on the x-axis with the first two representing a no gRNA (cell only control) and a single gRNA control, respectively.

TABLE 31

B2M Targeter Sequences

| SEQ ID NO | Description | Sequence |
|---|---|---|
| 998 | Tar_1_B2M | TTGTAGATAGTGGGGGTGAATTCAGTGTA |
| 999 | Tar_2_B2M | TTGTAGATAGTGGGGGTGAATTCAGTGTA/AltR2/ |

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (1136 sequences)

SEQ ID NO: 1 - protein, 1263 aa, unidentified
  REGION 1..1263: note = Description of Unknown: MAD7 sequence
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 2 - protein, 1334 aa, unidentified
  REGION 1..1334: note = Description of Unknown: MAD2 sequence
MSSLTKFTNKYSKQLTIKNELIPVGKTLENIKENGLIDGDEQLNENYQKAKIIVDDFLRDFINKALNNTQIGNWRELADALNKEDEDNIEKLQDKIRGIIVSKFETFDLFSSYSIKKDEKIIDDDNDVEEEELDLGKKTSSFKYIFKKNLFKLVLPSYLKTTNQDKLKIISSFDNFSTYFRGFFENRKNIFTKKPISTSIAYRIVHDNFPKFLDNIRCFNVWQTECPQLIVKADNYLKSKNVIAKDKSLANYFTVGAYDYFLSQNGIDFYNNIIGGLPAFAGHEKIQGLNEFINQECQKDSELKSKLKNRHAFKMAVLFKQILSDREKSFVIDEFESDAQVIDAVKNFYAEQCKDNNVIFNLLNLIKNIAFLSDDELDGIFIEGKYLSSVSQKLYSDWSKLRNDIEDSANSKQGNKELAKKIKTNKGDVEKAISKYEFSLSELNSIVHDNTKFSDLLSCTLHKVASEKLVKVNEGDWPKHLKNNEEKQKIKEPLDALLEIYNTLLIFNCKSFNKNGNFYVDYDRCINELSSVVYLYNKTRNYCTKKPYNTDKFKLNFNSPQLGEGFSKSKENDCLTLLFKKDDNYYVGIIRKGAKINFDDTQAIADNTDNCIFKMNYFLLKDAKKFIPKCSIQLKEVKAHFKKSEDDYILSDKEKFASPLVIKKSTFLLATAHVKGKKGNIKKFQKEYSKENPTEYRNSLNEWIAFCKEFLKTYKAATIFDITTLKKAEEYADIVEFYKDVDNLCYKLEFCPIKTSFIENLIDNGDLYLFRINNKDFSSKSTGTKNLHTLYLQAIFDERNLNNPTIMLNGGAELFYRKESIEQKNRITHKAGSILVNKVCKDGTSLDDKIRNEIYQYENKFIDTLSDEAKKVLPNVIKKEATHDITKDKRFTSDKFFFHCPLTINYKEGDTKQFNNEVLSFLRGNPDINIIGIDRGERNLIYVTVINQKGEILDSVSFNTVTNKSSKIEQTVDYEEKLAVREKERIEAKRSWDSISKIATLKEGYLSAIVHEICLLMIKHNAIVVLENLNAGFKRIRGGLSEKSVYQKFEKMLINKLNYFVSKKESDWNKPSGLLNGLQLSDQFESFEKLGIQSGFIFYVPAAYTSKIDPTTGFANVLNLSKVRNVDAIKSFFSNFNEISYSKKEALFKFSFDLDSLSKKGFSSFVKFSKSKWNVYTFGERIIKPKNKQGYREDKRINLTFEMKKLLNEYKVSFDLENNLIPNLTSANLKDTFWKELFFIFKTTLQLRNSVTNGKEDVLISPVKNAKGEFFVSGTHNKTLPQDCDANGAYHIALKGLMILERNNLVREEKDTKKIMAISNVDWFEYVQKRRGVL

SEQ ID NO: 3 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 4 - protein, 1228 aa, unidentified
  REGION 1..1228: note = Description of Unknown: Lachnospiraceae bacterium ND2006 sequence
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 5 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 6 - protein, 1257 aa, Prevotella bryantii
MQINNLKIIYMKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPKVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 7 - protein, 1154 aa, Proteocatella sphenisci
MENFKNLYPINKTLRFELRPYGKTLENFKKSGLLEKDAFKANSRRSMQAIIDEKFKETIEERLKYTEFSECDLGNMTSKDKKITDKAATNLKKQVILSFDDEIFNNYLKPDKNIDALFKNDPSNPVISTFKGFTTYFVNFFEIRKHIFKGESSGSMAYRIIDENLTTYLNNIEKIKKLPEELKSQLEGIDQIDKLNNYNEFITQSGITHYNEIIGGISKSENVKIQGINEGINLYCQKNKVKLPRLTPLYKMILSDRVSNSFVLDTIENDTELIEMISDLINKTEISQDVIMSDIQNIFIKYKQLGNLPGISYSSIVNAICSDYDNNFGDGKRKKSYENDRKKHLETNVYSINYISELLTDTDVSSNIKMRYKELEQNYQVCKENFNATNWMNIKNIKQSEKTNLIKDLLDILKSIQRFYDLFDIVDEDKNPSAEFYTWLSKNAEKLDFEFNSVYNKSRNYLTRKQYSDKKIKLNFDSPTLAKGWDANKEIDNSTIIMRKFNNDRGDYDYFLGIWNKSTPANEKIIPLEDNGLFEKMQYKLYPDPSKMLPKQFLSKIWKAKHPTTPEFDKKYKEGRHKKGPDFEKEFLHELIDCFKHGLVNHDEKYQDVFGFNLRNTEDYNSYTEFLEDVERCNYNLSFNKIADTSNLINDGKLYVFQIWSKDFSIDSKGTKNLNTIYFESLFSEENMIEKMFKLSGEAEIFYRPASLNYCEDIIKKGHHHAELKDKFDYPIIKDKRYSQDKFFFHVPMVINYKSEKLNSKSLNNRTNENLGQFTHIIGIDRGERHLIYLTVVDVSTGEIVEQKHLDEIINTDTKGVEHKTHYLNKLEEKSKTRDNERKSWEAIETIKELKEGYISHVINEIQKLQEKYNALIVMENLNYGFKNSRIKVEKQVYQKFETALIKKFNYIIDKKDPETYIHGYQLTNPITTLDKIGNQSGIVLYIPAWNTSKIDPVTGFVNLLYADDLKYKNQEQAKSFIQKIDNIYFENGEFKFDIDFSKWNNRYSISKTKWTLTSYGTRIQTFRNPQKNNKWDSAEYDLTEEFKLILNIDGTLKSQDVETYKKFMSLFKLMLQLRNSVTGTDIDYMISPVTDKTGTHFDSRENIKNLPADADANGAYNIARKGIMAIENIMNGISDPLKISNEDYLKYIQNQQE

SEQ ID NO: 8 - protein, 1235 aa, Anaerovibrio sp.
MVAFIDEFVGQYPVSKTLRFEARPVPETKKWLESDQCSVLFNDQKRNEYYGVLKELLDDYYRAYIEDALTSFTLDKALLENAYDLYCNRDTNAFSSCCEKLRKDLVKAFGNLKDYLLGSDQLKDLVKLKAKVDAPAGKGKKKIEVDSRLINWLNNNAKYSAEDREKYIKAIESFEGFVTYLTNYKQARENMFSSEDKSTAIAFRVIDQNMVTYFGNIRIYEKIKAKYPELYSALKGFEKFFSPTAYSEILSQSKIDEYNYQCIGRPIDDADFKGVNSLINEYRQKNGIKARELPVMSMLYKQILSDRDNSFMSEVINRNEEAIECAKNGYKVSYALFNELLQLYKKIFTEDNYGNIYVKTQPLTELSQALFGDWSILRNALDNGKYDKDIINLAELEKYFSEYCKVLDADDAAKIQDKFNLKDYFIQKNALDATLPDLDKITQYKPHLDAMLQAIRKYKLFSMYNGRKKMDVPENGIDFSNEFNAIYDKLSEFSILYDRIRNFATKKPYSDEKMKLSFNMPTMLAGWDYNNETANGCFLFIKDGKYFLGVADSKSKNIFDFKKNPHLLDKYSSKDIYYKVKYKQVSGSAKMLPKVVFAGSNEKIFGHLISKRILEIREKKLYTAAAGDRKAVAEWIDFMKSAIAIHPEWNEYFKFKFKNTAEYDNANKFYEDIDKQTYSLEKVEIPTEYIDEMVSQHKLYLFQLYTKDFSDKKKKKGTDNLHTMYWHGVFSDENLKAVTEGTQPIIKLNGEAEMFMRNPSIEFQVTHEHNKPIANKNPLNTKKESVFNYDLIKDKRYTERKFYFHCPITLNFRADKPIKYNEKINRFVENNPDVCIIGIDRGERHLLYYTVINQTGDILEQGSLNKISGSYTNDKGEKVNKETDYHDLLDRKEKGKHVAQQAWETIENIKELKAGYLSQVVYKLTQLMLQYNAVIVLENLNVGFKRGRTKVEKQVYQKFEKAMIDKLNYLVFKDRGYEMNGSYAKGLQLTDKFESFDKIGKQTGCIYYVIPSYTSHIDPKTGFVNLLNAKLRYENITKAQDTIRKFDSISYNAKADYFEFAFDYRSFGVDMARNEWVVCTCGDLRWEYSAKTRETKAYSVTDRLKELFKAHGIDYVGGENLVSHITEVADKHFLSTLLFYLRLVLKMRYTVSGTENENDFILSPVEYAPGKFFDSREATSTEPMNADANGAYHIALKGLMTIRGIEDGKLHNYGKGGENAAWFKFMQNQEYKNNG

SEQ ID NO: 9 - protein, 1264 aa, Moraxella caprae
MLFQDFTHLYPLSKTMRFELKPIGKTLEHIHAKNFLSQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAITYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGALYDELAKIPTLYNKVRDYLSQKPFSTEKYKLNFGNPTLLNGWDLNKEKDNFGIILQKDGCYYLALLDKAHKKVFDNAPNTGKNVYQKMIYKLLPGPNKMLPKVFFAKSNLDYYNPSAELLDKYAQGTHKKGNNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSKDNLANPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDEADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWKICSHGDKRYVYDKTANQNKGATKGINVNDELKSLFARHHINDKQPNLVMDICQNNDKEFHKSLIYLLKTLLALRYSNASSDEDFILSPVANDEGMFFNSALADDTQPQNADANGAYHIALKGLWVLEQIKNSDDLNKVKLAIDNQTWLNFAQNR

SEQ ID NO: 10 - protein, 1230 aa, unidentified
  REGION 1..1230: note = Description of Unknown: Lachnospiraceae bacterium COE1 sequence
MHENNGKIADNFIGIYPVSKTLRFELKPVGKTQEYIEKHGILDEDLKRAGDYKSVKKIIDAYHKYFIDEALNGIQLDGLKNYYELYEKKRDNNEEKEFQKIQMSLRKQIVKRFSEHPQYKYLFKKELIKNVLPEFTKDNAEEQTLVKSFQEFTTYFEGFHQNRKNMYSDEEKSTAIAYRVVHQNLPKYIDNMRIFSMILNTDIRSDLTELFNNLKTKMDITIVEEYFAIDGFNKVVNQKGIDVYNTILGAFSTDDNTKIKGLNEYINLYNQKNKAKLPKLKPLFKQILSDRDKISFIPEQFDSDTEVLEAVDMFYNRLLQFVIENEGQITISKLLTNFSAYDLNKIYVKNDTTISAISNDLFDDWSYISKAVRENYDSENVDKNKRAAAYEEKKEKALSKIKMYSIEELNFFVKKYSCNECHIEGYFERRILEILDKMRYAYESCKILHDKGLINNISLCQDRQAISELKDFLDSIKEVQWLLKPLMIGQEQADKEEAFYTELLRIWEELEPITLLYNKVRNYVTKKPYTLEKVKLNFYKSTLLDGWDKNKEKDNLGIILLKDGQYYLGIMNRRNNKIADDAPLAKTDNVYRKMEYKLLTKVSANLPRIFLKDKYNPSEEMLEKYEKGTHLKGENFCIDDCRELIDFFKKGIKQYEDWGQFDFKFSDTESYDDISAFYKEVEHQGYKITFRDIDETYIDSLVNEGKLYLFQIYNKDFSPYSKGTKNLHTLYWEMLFSQQNLQNIVYKLNGNAEIFYRKASINQKDVVVHKADLPIKNKDPQNSKKESMFDYDIIKDKRFTCDKYQFHVPITMNFKALGENHFNRKVNRLIHDAENMHIIGIDRGERNLIYLCMIDMKGNIVKQISLNEIISYDKNKLEHKRNYHQLLKTREDENKSARQSWQTIHTIKELKEGYLSQVIHVITDLMVEYNAIVVLEDLNFGFKQGRQKFERQVYQKFEKMLIDKLNYLVDKSKGMDEDGGLLHAYQLTDEFKSFKQLGKQSGFLYYIPAWNTSKLDPTTGFVNLFYTKYESVEKSKEFINNFTSILYNQEREYFEFLFDYSAFTSKAEGSRLKWTVCSKGERVETYRNPKKNNEWDTQKIDLTFELKKLFNDYSISLLDGDLREQMGKIDKADFYKKFMKLFALIVQMRNSDEREDKLISPVLNKYGAFFETGKNERMPLDADANGAYNIARKGLWIIEKIKNTDVEQLDKVKLTISNKEWLQYAQEHIL

SEQ ID NO: 11 - protein, 1261 aa, Eubacterium coprostanoligenes
MDFFKNDMYFLCINGIIVISKLFAYLFLMYKRGVVMIKDNFVNVYSLSKTIRMALIPWGKTEDNFYKKFLLEEDEERAKNYIKVKGYMDEYHKNFIESALNSVVLNGVDEYCELYFKQNKSDSEVKKIESLEASMRKQISKAMKEYTVDGVKIYPLLSKKEFIRELLPEFLTQDEEIETLEQFNDFSTYFQGFWENRKNIYTDEEKSTGVPYRCINDNLPKFLDNVKSFEKVILALPQKAVDELNANFNGVYNVDVQDVFSVDYFNFVLSQSGIEKYNNIIGGYSNSDASKVQGLNEKINLYNQQIAKSDKSKKLPLLKPLYKQILSDRSSLSFIPEKFKDDNEVLNSINVLYDNIAESLEKANDLMSDIANYNTDNIFISSGVAVTDISKKVFGDWSLIRNNWNDEYESTHKKGKNEEKFYEKEDKEFKKIKSFSVSELQRLANSDLSIVDYLVDESASLYADIKTAYNNAKDLLSNEYSHSKRLSKNDDAIELIKSFLDSIKNYEAFLKPLCGTGKEESKDNAFYGAFLECFEEIRQVDAVYNKVRNHITQKPYSNDKIKLNFQNPQFLAGWDKNKERAYRSVLLRNGEKYYLAIMEKGKSKLFEDFPEDESSPFEKIDYKLLPEPSKMLPKVFFATSNKDLFNPSDEILNIRATGSFKKGDSFNLDDCHKFIDFYKASIENHPDWSKFDFDFSETNDYEDISKFFKEVSDQGYSIGYRKISESYLEEMVDNGSLYMFQLYNKDFSENRKSKGTPNLHTLYFKMLFDERNLEDVVYKLSGGAEMFYRKPSIDKNEMIVHPKNQPIDNKNPNNVKKTSTFEYDIVKDMRYTKPQFQLHLPIVLNFKANSKGYINDDVRNVLKNSEDTYVIGIDRGERNLVYACVVDGNGKLVEQVPLNVIEADNGYKTDYHKLLNDREEKRNEARKSWKTIGNIKELKEGYISQVVHKICQLVVKYDAVIAMEDLNSGFVNSRKKVEKQVYQKFERMLTQKLNYLVDKKLDPNEMGGLLNAYQLTNEATKVRNGRQDGIIFYIPAWLTSKIDPTTGFVNLLKPKYNSVSASKEFFSKFDEIRYNEKENYFEFSFNYDNFPKCNADFKREWTVCTYGDRIRTFRDPENNNKFNSEVVVLNDEFKNLFVEFDIDYTDNLKEQILAMDEKSFYKKLMGLLSLTLQMRNSISKNVDVDYLISPVKNSNGEFYDSRNYDITSSLPCDADSNGAYNIARKGLWAINQIKQADDETKANISIKNSEWLQYAQNCDEV

SEQ ID NO: 12 - protein, 1064 aa, Smithella sp.
MEKYKITKTIRFKLLPDKIQDISRQVAVLQNSTNAEKKNNLLRLVQRGQELPKLLNEYIRYSDNHKLKSNVTVHFRWLRLFTKDLFYNWKKDNTEKKIKISDVVYLSHVFEAFLKEWESTIERVNADCNKPEESKTRDAEIALSIRKLGIKHQLPFIKGFVDNSNDKNSEDTKSKLTALLSEFEAVLKICEQNYLPSQSSGIAIAKASFNYYTINKKQKDFEAEIVALKKQLHARYGNKKYDQLLRELNLIPLKELPLKELPLIEFYSEIKKRKSTKKSEFLEAVSNGLVFDDLKSKFPLFQTESNKYDEYLKLSNKITQKSTAKSLLSKDSPEAQKLQTEITKLKKNRGEYFKKAFGKYVQLCELYKEIAGKRGKLKGQIKGIENERIDSQRLQYWALVLEDNLKHSLILIPKEKTNELYRKVWGAKDDGASSSSSSTLYYFESMTYRALRKLCFGINGNTFLPEIQKELPQYNQKEFGEFCFHKSNDDKEIDEPKLISFYQSVLKTDFVKNTLALPQSVFNEVAIQSFETRQDFQIALEKCCYAKKQIISESLKKEILENYNTQIFKITSLDLQRSEQKNLKGHTRIWNRFWTKQNEEINYNLRLNPEIAIVWRKAKKTRIEKYGERSVLYEPEKRNRYLHEQYTLCTTVTDNALNNEITFAFEDTKKKGTEIVKYNEKINQTLKKEFNKNQLWFYGIDAGEIELATLALMNKDKEPQLFTVYELKKLDFFKHGYIYNKERELVIREKPYKAIQNLSYFLNEELYEKTFRDGKFNETYNELFKEKHVSAIDLTTAKVINGKIILNGDMITFLNLRILHAQRKIYEELIENPHAELKEKDYKLYFEIEGKDKDIYISRLDFEYIKPYQEISNYLFAYFASQQINEAREEEQINQTKRALAGNMIGVIYYLYQKYRGIISIEDLKQTKVESDRNKFEGNIERPLEWALYRKFQQEGYVPPISELIKLRELEKFPLKDVKQPKYENIQQFGIIKFVSPEETSTTCPKCLRRFKDYDKNKQEGFCKCQCGFDTRNDLKGFEGLNDPDKVAAFNIAKRGFEDLQKYK

SEQ ID NO: 13 - protein, 1232 aa, Sulfuricurvum sp.
MLHAFTNQYQLSKTLRFGATLKEDEKKCKSHEELKGFVDISYENMKSSATIAESLNENELVKKCERCYSEIVKFHNAWEKIYYRTDQIAVYKDFYRQLSRKARFDAGKQNSQLITLASLCGMYQGAKLSRYITNYWKDNITRQKSFLKDFSQQLHQYTRALEKSDKAHTKPNLINFNKTFMVLANLVNEIVIPLSNGAISFPNISKLEDGEESHLIEFALNDYSQLSELIGELKDAIATNGGYTPFAKVTLNHYTAEQKPHVFKNDIDAKIRELKLIGLVETLKGKSSEQIEEYFSNLDKFSTYNDRNQSVIVRTQCFKYKPIPFLVKHQLAKYISEPNGWDEDAVAKVLDAVGAIRSPAHDYANNQEGFDLNHYPIKVAFDYAWEQLANSLYTTVTFPQEMCEKYLNSIYGCEVSKEPVFKFYADLLYIRKNLAVLEHKNNLPSNQEEFICKINNTFENIVLPYKISQFETYKKDILAWINDGHDHKKYTDAKQQLGFIRGGLKGRIKAEEVSQKDKYGKIKSYYENPYTKLTNEFKQISSTYGKTFAELRDKFKEKNEITKITHFGIIIEDKNRDRYLLASELKHEQINHVSTILNKLDKSSEFITYQVKSLTSKTLIKLIKNHTTKKGAISPYADFHTSKTGFNKNEIEKNWDNYKREQVLVEYVKDCLTDSTMAKNQNWAEFGWNFEKCNSYEDIEHEIDQKSYLLQSDTISKQSIASLVEGGCLLLPIINQDITSKERKDKNQFSKDWNHIFEGSKEFRLHPEFAVSYRTPIEGYPVQKRYGRLQFVCAFNAHIVPQNGEFINLKKQIENFNDEDVQKRNVTEFNKKVNHALSDKEYVVIGIDRGLKQLATLCVLDKRGKILGDFEIYKKEFVRAEKRSESHWEHTQAETRHILDLSNLRVETTIEGKKVLVDQSLTLVKKNRDTPDEEATEENKQKIKLKQLSYIRKLQHKMQTNEQDVLDLINNEPSDEEFKKRIEGLISSFGEGQKYADLPINTMREMISDLQGVIARGNNQTEKNKIIELDAADNLKQGIVANMIGIVNYIFAKYSYKAYISLEDLSRAYGGAKSGYDGRYLPSTSQDEDVDFKEQQNQMLAGLGTYQFFEMQLLKKLQKIQSDNTVLRFVPAFRSADNYRNILRLEETKYKSKPFGVVHFIDPKFTSKKCPVCSKTNVYRDKDDILVCKECGFRSDSQLKERENNIHYIHNGDDNGAYHIALKSVENLIQMK

SEQ ID NO: 14 - protein, 1057 aa, unidentified
  REGION 1..1057: note = Description of Unknown: Microgenomates (Roizmanbacteria) bacterium sequence
MEIQELKNLYEVKKTVRFELKPSKKKIFEGGDVIKLQKDFEKVQKFFLDIFVYKNEHTKLEFKKKREIKYTWLRTNTKNEFYNWRGKSDTGKNYALNKIGFLAEEILRWLNEWQELTKSLKDLTQREEHKQERKSDIAFVLRNFLKRQNLPFIKDFFNAVIDIQGKQGKESDDKIRKFREEIKEIEKNLNACSREYLPTQSNGVLLYKASFSYYTLNKTPKEYEDLKKEKESELSSVLLKEIYRRKRFNRTTNQKDTLFECTSDWLVKIKLGKDIYEWTLDEAYQKMKIWKANQKSNFIEAVAGDKLTHQNFRKQFPLFDASDEDFETFYRLTKALDKNPENAKKIAQKRGKFFNAPNETVQTKNYHELCELYKRIAVKRGKIIAEIKGIENEEVQSQLLTHWAVIAEERDKKFIVLIPRKNGGKLENHKNAHAFLQEKDRKEPNDIKVYHFKSLTLRSLEKLCFKEAKNTFAPEIKKETNPKIWFPTYKQEWNSTPERLIKFYKQVLQSNYAQTYLDLVDFGNLNTFLETHFTTLEEFESDLEKTCYTKVPVYFAKKELETFADEFEAEVFEITTRSISTESKRKENAHAEIWRDFWSRENEEENHITRLNPEVSVLYRDEIKEKSNTSRKNRKSNANNRFSDPRFTLATTITLNADKKKSNLAFKTVEDINIHIDNFNKKFSKNFSGEWVYGIDRGLKELATLNVVKFSDVKNVFGVSQPKEFAKIPIYKLRDEKAILKDENGLSLKNAKGEARKVIDNISDVLEEGKEPDSTLFEKREVSSIDLTRAKLIKGHIISNGDQKTYLKLKETSAKRRIFELFSTAKIDKSSQFHVRKTIELSGTKIYWLCEWQRQDSWRTEKVSLRNTLKGYLQNLDLKNRFENIETIEKINHLRDAITANMVGILSHLQNKLEMQGVIALENLDTVREQSNKKMIDEHFEQSNEHVSRRLEWALYCKFANTGEVPPQIKESIFLRDEFKVCQIGILNFIDVKGTSSNCPNCDQESRKTGSHFICNFQNNCIFSSKENRNLLEQNLHNSDDVAAFNIAKRGLEIVKV

SEQ ID NO: 15 - RNA, 10 nt, synthetic construct
  misc_feature 1..10: note = Description of Artificial Sequence: Synthetic oligonucleotide
  source 1..10: mol_type = other RNA
taatttctac

SEQ ID NO: 16 - protein, 1372 aa, synthetic construct
  REGION 1..1372: note = Description of Artificial Sequence: Synthetic polypeptide
MGHHHHHHSSGLVPRGSGTMKEFTNQYSLTKTLRFELRPVGETAEKIEDFKSGGLKQTVEKDRERTEAYKQLKEVIDSYHRDFIEQAFARQQTLSEEDFKQTYQLYKEAQKEKDGETLTKQYEHLRKKIAAMFSKATKEWAVMGENNELIGKNKESKLYQWLEKNYRAGRIEKEEFDHNAGLIEYFEKFSTYFVGFDKNRANMYSKEAKATAISFRTINENMVKHFDNCQRLEKIKSKYPDLAEELKDFEEFFKPSYFINCMNQSGIDYYNISAIGGKDEKDQKANMKINLFTQKNHLKGSDKPPFFAKLYKQILSDREKSVVIDEFEKDSELTEALKNVFSKDGLINEEFFTKLKSALENFMLPEYQGQLYIRNAFLTKISANIWGSGSWGIIKDAVTQAAENNFTRKSDKEKYAKKDFYSIAELQQAIDEYIPTLENGVQNASLIEYFRKMNYKPRGSEEDAGLIEEINNNLRQAGIVLNQAELGSGKQREENIEKIKNLLDSVLNLERFLKPLYLEKEKMRPKAANLNKDFCESFDPLYEKLKTFFKLYNKVRNYATKKPYSKDKFKINFDTATLLYGWSLDKETANLSVIFRKREKFYLGIINRYNSQIFNYKIAGSESEKGLERKRSLQQKVLAEEGEDYFEKMVYHLLLGASKTIPKCSTQLKEVKAHFQKSSEDYIIQSKSFAKSLTLTKEIFDLNNLRYNTETGEISSELSDTYPKKFQKGYLTQTGDVSGYKTALHKWIDFCKEFLRCYRNTEIFTFHFKDTKEYESLDEFLKEVDSSGYEISFDKIKASYINEKVNAGELYLFEIYNKDFSEYSKGKPNLHTIYWKSLFETQNLLDKTAKLNGKAEIFFRPRSIKHNDKIIHRAGETLKNKNPLNEKPSSRFDYDITKDRRFTKDKFFLHCPITLNFKQDKPVRFNEQVNLYLKDNPDVNIIGIDRGERHLLYYTLINQNGEILQQGSLNRIGEEESRPTDYHRLLDEREKQRQQARETWKAVEGIKDLKAGYLSRVVHKLAGLMVQNNAIVVLEDLNKGFKRGRFAVEKQVYQNFEKALIQKLNYLVFKEVNSKDAPGHYLKAYQLTAPFISFEKLGTQSGFLFYVRAWNTSKIDPATGFTDQIKPKYKNQKQAKDFMSSFDSVRYNRKENYFEFEADFEKLAQKPKGRTRWTICSYGQERYSYSPKERKFVKHNVTQNLAELFNSEGISFDSGQCFKDEILKVEDASFFKSIIFNLRLLLKLRHTCKNAEIERDFIISPVKGNNSSFFDSRIAEQENITSIPQNADANGAYNIALKGLMNLHNISKDGKAKLIKDEDWIEFVQKRKFAAAKRPAATKKAGQAKKKKASGSGAGSPKKKRKVEDPKKKRKV

SEQ ID NO: 17 - DNA, 4122 bp, synthetic construct
  misc_feature 1..4122: note = Description of Artificial Sequence: Synthetic polynucleotide
  source 1..4122: mol_type = other DNA
atgggccaccatcatcatcatcatagcagcggcctggtgccgcgcggcagcggtaccatgaaggagtttaccaaccaatattccttaaccaagaccctgcggttcgagttgcggccagtcggcgaaacagcagaaaagatcgaagattttaaatcgggcgggctcaagcaaacagtggaaaaggatcgtgagcgtacagaagcgtataagcagttgaaagaggttattgactcctatcatcgtgacttcattgagcaagcttttgcgcgccagcagacgctgtccgaggaggattttaaacaaacatatcaactgtacaaagaggcccagaaagagaaggatggggaaacattaacaaagcagtacgagcatttacggaagaaaatcgcagctatgttcagcaaggctacgaaggaatgggccgttatgggggagaataacgaattgatcgggaaaaacaaagagtcaaagttgtatcagtggctggagaagaactaccgcgcaggtcgcatcgaaaaagaggaattcgaccataatgcgggcttaatcgaatacttcgagaaattttccacatatttcgtaggttttgacaaaaatcgtgcgaatatgtattcaaaggaggcaaaggcgaccgcaatttccttccggacgattaatgagaacatggtcaagcatttcgataattgccagcggctcgagaagattaaatctaaatatcctgatttggccgaggagctgaaggattttgaggagttttttaaacctagctatttcattaattgtatgaatcaatcgggtatcgactactacaatatcagcgcgatcggcggtaaggatgaaaaggatcagaaagcgaatatgaagatcaaccttttcacgcaaaaaaatcatttaaagggcagtgataaaccaccattttttgctaagctctacaagcaaattttgagtgaccgggagaagtccgtggtaatcgacgagttcgaaaaggacagcgaattgacagaggcactcaaaaacgtgttttccaaggacggtttgatcaatgaggagttttttacaaagttaaaaagtgcattagaaaattttatgttgcctgaatatcaaggtcaactctacatccgtaacgctttccttacgaagatcagcgcaaacatttggggctctggttcttggggcatcatcaaggacgcagttacccaggctgcggaaaacaatttcacgcgtaagtctgacaaggaaaagtatgccaagaaagacttctattccattgctgaactccagcaggctattgatgaatacattcctactctggagaacggggttcaaaacgcatcactcatcgagtactttcgcaaaatgaattacaaaccacgcggttctgaagaagacgcaggcttgatcgaagaaattaataacaacctgcgtcaggctgggatcgtcctgaatcaagccgagctggggtctggtaagcagcgggaagagaatattgaaaaaattaagaacttattagattcggttttgaatctcgaacgtttcttaaagccactttacttggagaaagagaaaatgcgtccaaaagctgctaacctgaataaggatttttgtgagtcatttgatccactttacgagaaactgaaaacgtttttcaagctctacaataaagtacgtaactacgcaacaaagaaaccatactcaaaggacaaatttaagatcaattttgataccgctacgttattatatgggtggagtttggataaggaaaccgcgaatctcagcgtcattttccgtaaacgcgaaaaattctatttgggtatcatcaaccggtacaatagccagattttcaattataagattgcgggcagtgagagcgagaaagggttagagcgtaagcggtcgctgcagcaaaaggtgcttgcagaggagggtgaagattattttgagaaaatggtataccacctgctgcttggcgcgtcgaaaactattccgaaatgctcgacacagttgaaagaagtaaaagcacactttcaaaagtcatcagaagattatattatccaatccaaatcatttgcaaagtcattaacattaacaaaagagatctttgacttaaataatctgcggtataacacagaaacgggcgaaattagttccgagctttctgatacatatccgaagaagttccagaaggggtatctcacacaaacaggcgacgtttcgggttacaaaactgctctgcataagtggattgatttctgcaaagagttcttgcgttgctatcgtaatacggagatcttcacgttccatttcaaggacacgaaggagtacgagtcgttagatgagttcttgaaagaagtggatagttcaggttatgagatttcattcgataagatcaaagcctcttatatcaacgagaaggttaatgcaggcgagctgtacttgttcgagatctataataaagatttctccgagtattccaaaggtaagccaaatctgcataccatttattggaaaagtctcttcgagactcaaaacttgctggataaaacagcgaaactcaacggcaaggcagagatcttcttccggccacgttcgatcaaacacaacgacaaaatcatccaccgtgcgggcgaaacacttaagaataaaaacccgctcaatgaaaagcctagttcgcgtttcgattacgatattacgaaagatcgtcgttttacgaaagacaaattttttttacactgccctattacgttaaactttaagcaggacaagcctgttcgctttaatgaacaagtcaacttatacttaaaagacaatccagacgtgaatattatcggtatcgatcgtggtgagcgtcacttgctttattacactttgatcaatcagaatggtgagatcttacagcagggttcacttaatcgcattggtgaggaagaatctcggcctacggactaccatcggttactcgatgagcgtgaaaagcagcgtcaacaagcacgggagacgtggaaagcagtagaagggattaaggacttaaaagctgggtatctttcacgggttgtacataaacttgcaggtttaatggtacaaaacaacgcaattgtcgttctggaagatcttaacaagggttttaagcgcggtcgtttcgctgttgagaaacaggtgtaccagaacttcgaaaaagcacttattcaaaagcttaactatttagtgttcaaggaggtcaactctaaagacgcccctggccactatttgaaggcatatcagcttacggcccctttcatctcgttcgaaaaattgggtactcagagcggtttccttttttatgtgcgcgcatggaatacctcgaagatcgacccggcgacgggttttaccgaccaaatcaaaccaaagtataaaaaccaaaaacaagctaaagacttcatgtcaagcttcgactctgtccggtacaaccgcaaggaaaattattttgaattcgaggcggactttgaaaaactggcacagaaacctaaggggcgcacccgctggacgatttgttcctatggccaggaacggtactcttactccccaaaagaacggaagtttgtaaagcacaacgttacacaaaatcttgctgagctttttaattcagagggtatctcgttcgactccgggcagtgtttcaaggatgagatcctgaaggtcgaggatgccagtttctttaagtctattattttcaatcttcgcctccttctcaagcttcgtcacacttgcaagaacgccgagatcgaacgtgatttcatcatttctcctgtcaaggggaacaattcgtccttttttgactcccgtattgccgaacaagaaaatatcaccagcattccacagaatgctgatgcaaacggtgcatacaacatcgcgctgaagggcctgatgaacctccataatatctctaaggacggcaaggcaaaattaattaaggatgaagattggatcgaatttgtccaaaaacgcaagttcgcggccgcaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 18 - RNA, 12 nt, synthetic construct
  misc_feature 1..12: note = Description of Artificial Sequence: Synthetic oligonucleotide
  source 1..12: mol_type = other RNA
taattttctact

SEQ ID NO: 19 - skipped

SEQ ID NO: 20 - RNA, 10 nt, synthetic construct
  misc_feature 1..10: note = Description of Artificial Sequence: Synthetic oligonucleotide
  source 1..10: mol_type = other RNA
gaatttctac

SEQ ID NO: 21-22 - skipped (2 entries)

SEQ ID NO: 23 - protein, 7 aa, synthetic construct
  REGION 1..7: note = Description of Artificial Sequence: Synthetic peptide
PKKKRKV

SEQ ID NO: 24 - protein, 16 aa, synthetic construct
  REGION 1..16: note = Description of Artificial Sequence: Synthetic peptide
KRPAATKKAGQAKKKK

SEQ ID NO: 25 - protein, 9 aa, synthetic construct
  REGION 1..9: note = Description of Artificial Sequence: Synthetic peptide
PAAKRVKLD

SEQ ID NO: 26 - protein, 11 aa, synthetic construct
  REGION 1..11: note = Description of Artificial Sequence: Synthetic peptide
RQRRNELKRSP

SEQ ID NO: 27 - protein, 38 aa, synthetic construct
  REGION 1..38: note = Description of Artificial Sequence: Synthetic polypeptide
NQSSNFGPMKGGNFGGRSSGPYGGGGQYFAKPRNQGGY

SEQ ID NO: 28 - protein, 42 aa, synthetic construct
  REGION 1..42: note = Description of Artificial Sequence: Synthetic polypeptide
RMRIZFKNKGKDTAELRRRRVEVSVELRKAKKDEQILKRRNV

SEQ ID NO: 29 - protein, 1312 aa, synthetic construct
  REGION 1..1312: note = Description of Artificial Sequence: Synthetic polypeptide
MGHHHHHHSSGLVPRGSLQMKTLSDFTNLFPLSKTLRFKLIPIGNTLKNIEASGILDEDRHRAESYVKVKAIIDEYHKAFIDRVLSDTCLQTESIGKHNSLEEFFFYYQIGAKSEQQKKTFKKIQDALRKQIADSLTKDKHFSRIDKKELIQEDLIQFVRDGEDAAEKTSLISEFQNFTVYFTGFHENRQNMYSPDEKSTAIAYRLINENLPKFVDNMKVFDRIAASELASCFDELYHNFEEYLQVERLHDIFSLDYFNLLLTQKHIDVYNALIGGKATETGEKIKGLNEYINLYNQRHKQEKLPKFKMLFKQILTDREAISWLPRQFDDNSQLLSAIEQCYNHLSTYTLKDGSLKYLLENLHTYDTEKIFIRNDSLLTEISQRHYGSWSILPEAIKRHLERANPQKRRETYEAYQSRIEKAFKAYPGFSIAFLNGCLTETGKESPSIESYFESLGAVETETSQQENWFARIANAYTDFREMQNRLHATDVPLAQDAEAVARIKKLLDALKGLQLFIKPLLDTGEEAEKDERFYGDFTEFWNELDTITPLYNMVRNYLTRKPYSEEKIKLNFQNPTLLNGWDLNKEVDNTSVILRRNGRYYLAIMHRNHRRVFSQYPGTERGDCYEKMEYKLLPGANKMLPKVFFSKSRIDEFNPSEELLARYQQGTHKKGENFNLHDCHALIDFFKDSIEKHEEWRNFHFKFSDTSSYTDMSGFYREIETQGYKLSFVPVACEYIDELVRDGKIFLFQIYNKDFSTYSKGKPNMHTLYWEMLFDERNLMNVVYKLNGQAEIFFRKASLSARHPEHPAGLPIKKKQAPTEESCFPYDLIKNKRYTVDQFQFHVPITINFKATGTSNINPSVTDYIRTADDLHIIGIDRGERHLLYLVVIDSQGRICEQFSLNEIVTQYQGHQYRTDYHALLQKKEDERQKARQSWQSIENIKELKEGYLSQVVHKVSELMIKYKAIVVLEDLNAGFKRSRQKVEKQVYQKFEKMLIDKLNYLVFKTAEADQPGGLLHAYQLTNKFESFKKMGKQSGFLFYIPAWNTSKIDPTTGFVNLFDTRYENVDKSRAFFGKFDSIRYRADKGTFEWTFDYNNFHKKAEGTRSSWCLSSHGNRVRTFRNPAKNNQWDNEEIDLTQAFRDLFEAWGIEITSNLKEAICNQSEKKFFSELFELFKLMIQLRNSVTGTNIDYMVSPVENHYGTFFDSRTCDSSLPANADANGAYNIARKGLMLARRIQATPENDPISLTLSNKEWLRFAQGLDETTTYEAAAKRPAATKKAGQAKKKKASGSGAGSPKKKRKVEDPKKKRKV

SEQ ID NO: 30 - DNA, 3942 bp, synthetic construct
  misc_feature 1..3942: note = Description of Artificial Sequence: Synthetic polynucleotide
  source 1..3942: mol_type = other DNA
atgggccaccatcatcatcatcatagcagcggcctggtgccgcgcggcagcctgcagatgaagaccttgtctgattttaccaatctgttccctttatctaagactctccgtttcaagctgattccaatcggcaacacgctcaagaacattgaagctagtggcatccttgacgaggatcgccaccgcgcggagtcctatgtcaaggtcaaggccatcatcgacgaatatcataaagctttcatcgatcgggtcctgtcggatacttgcctccagacggaatctatcggcaaacacaacagtctcgaggaattctttttctactaccaaattggtgcaaaaagtgaacagcagaaaaagacgtttaaaaagattcaagacgccttgcgcaaacaaatcgcagatagcctcaccaaggacaaacatttttcacggattgataaaaaagaattgatccaagaggatttgatccagtttgtgcgcgatggggaggatgccgctgaaaagacgtctctgatttccgaatttcaaaatttcacagtttattttaccgggtttcatgagaatcgccagaacatgtacagtccggacgagaagtccacggccatcgcatatcgcttaattaacgagaatctcccaaaattcgtagacaacatgaaagtttttgaccgtatcgcggcgtccgaattggcatcgtgtttcgacgaattataccacaacttcgaggaatacctccaagtggagcggttacatgatatctttagtttggactatttcaatctgcttctcacgcagaaacatatcgacgtctataatgctctgatcggtgggaaggcaaccgaaaccggggaaaagatcaagggcttaaatgaatacatcaatctctacaatcaacgtcacaagcaggaaaaactgccaaaattcaagatgttattcaagcaaattcttaccgaccgtgaggcaatcagctggttgccacgccaatttgacgataatagtcagttactctcagccattgaacagtgttataaccacctttcgacctacacactcaaggatgggtcactcaaatacctgttagaaaacctgcatacatacgatactgaaaagatcttcatccgcaatgacagtttacttacggaaatctcccaacggcattacggttcgtggtcgattttaccagaagctatcaaacgtcatctcgagcgcgcgaacccgcaaaaacggcgcgaaacatacgaggcctatcaatctcgcattgagaaggcctttaaggcatatccggggttttcaattgctttcctcaatgggtgtttaacagagacaggtaaggagtcgccatccatcgaaagctattttgaaagtctgggtgctgtcgaaacagagacctctcagcaggaaaactggtttgcccgcatcgcaaacgcttatacggactttcgtgaaatgcaaaatcggctgcacgccactgacgtgccgttggctcaagacgctgaggcagtggcccggatcaagaagctgttagatgcactgaaaggcctgcaattattcattaagcctcttttggatactggcgaagaagcagagaaagatgaacggttctatggggactttaccgaattctggaacgagttagacactatcacgccattgtacaatatggtacggaactatctcacgcgtaagccttatagtgaagaaaaaatcaagctcaatttccagaatccgacattactgaacggttgggatttgaacaaagaggtagataatacatctgtcatcctccgccggaatggtcgttattatcttgccatcatgcaccgcaaccaccggcgtgtattttcacagtatccaggcacagaacgtggcgattgttatgagaaaatggaatataaactgcttccgggcgccaacaagatgctcccaaaagtcttcttctctaaatcacgcatcgatgaattcaaccctagcgaagaattattagcacgttaccagcaaggtacccacaagaagggtgagaattttaatttacacgactgccatgccttgattgatttttttaaagactctattgagaaacatgaagaatggcgtaactttcattttaaatttagtgatacgtccagttacaccgacatgagcggcttttatcgtgaaatcgaaacacagggttacaagttgtcatttgtgccagtggcgtgtgaatacatcgatgagttggtacgtgatggcaaaatctttttgttccagatctataataaggacttttcgacctactctaagggcaagccaaatatgcacactctttattgggaaatgcttttcgacgagcggaacctgatgaacgtggtgtataaactcaatggccaagcagagatcttttttcgtaaagcatcactgagcgcacgtcaccctgagcacccggcagggttgccaattaaaaaaaaacaggccccgacggaagaatcttgtttcccatatgatctcattaagaataagcggtatacagttgaccagtttcagtttcacgtgccaattactattaattttaaagcaactgggacttcaaatatcaacccgtcggtcactgattatattcgtacggccgatgacctccatatcattggcattgatcgcggtgagcgccatttactttatttagtggtgattgactcacaagggcgcatctgtgaacagttttccttaaacgagatcgtaacgcaataccaaggtcaccagtaccgtacagattatcatgctctcttgcagaaaaaagaggatgaacggcaaaaagctcgccagtcttggcaatcgatcgaaaacatcaaggaattaaaagaggggtatctgagccaagtagtgcacaaggtttctgaactgatgatcaaatataaagcaattgtggtgttggaagatttaaatgctgggttcaagcggagtcggcagaaggttgaaaagcaagtgtatcaaaaatttgagaagatgctgatcgacaaacttaactatcttgtgttcaagaccgcagaagctgaccaacctggcggcctcctgcacgcataccaattaacaaataaatttgagtcattcaagaaaatggggaagcaaagtggcttcctcttctacattcctgcatggaacacgtctaaaatcgacccgaccacgggctttgtcaacctttttgatacccggtatgagaacgtagacaaatcccgtgccttcttcggcaaattcgatagcatccgctaccgtgcggacaagggcacgttcgagtggacgttcgattataataactttcacaaaaaggccgaaggtacgcggtcgagctggtgtttgtcttctcatggtaaccgggtccgtactttccgcaatcctgcgaaaaacaaccaatgggacaacgaagagatcgacttaacacaagcgttccgcgatctgtttgaagcttgggggatcgagatcacttcgaacttaaaagaggccatttgcaaccagtctgagaagaaattcttttctgagcttttcgaactgttcaaacttatgatccagctgcggaactcagtgacaggcacgaatatcgactatatggtgagcccagtcgagaatcactacggcacgttcttcgattcgcgcacatgcgattcgtctctgccggctaacgctgacgctaatggtgcttataatattgcccgtaaggggttaatgctggctcgccgcattcaggctacccctgagaatgatccgatctccttaacattgagcaacaaagagtggttacgctttgcacaggggctcgatgagacaacaacctacgaggcggccgcaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 31 - protein, 8 aa, synthetic construct
  REGION 1..8: note = Description of Artificial Sequence: Synthetic peptide
PQPKKKPL

SEQ ID NO: 32 - protein, 12 aa, synthetic construct
  REGION 1..12: note = Description of Artificial Sequence: Synthetic peptide
SALIKKKKKMAP

SEQ ID NO: 33 - protein, 5 aa, synthetic construct
  REGION 1..5: note = Description of Artificial Sequence: Synthetic peptide
DRLRR

SEQ ID NO: 34 - protein, 7 aa, synthetic construct
  REGION 1..7: note = Description of Artificial Sequence: Synthetic peptide
PKQKKRK

SEQ ID NO: 35 - protein, 10 aa, synthetic construct
  REGION 1..10: note = Description of Artificial Sequence: Synthetic peptide
RKLKKKIKKL

SEQ ID NO: 36 - protein, 10 aa, synthetic construct
  REGION 1..10: note = Description of Artificial Sequence: Synthetic peptide
REKKKFLKRR

SEQ ID NO: 37 - protein, 20 aa, synthetic construct
  REGION 1..20: note = Description of Artificial Sequence: Synthetic peptide
KRKGDEVDGVDEVAKKKSKK

SEQ ID NO: 38 - protein, 17 aa, synthetic construct
  REGION 1..17: note = Description of Artificial Sequence: Synthetic peptide
RKCLQAGMNLEARKTKK

SEQ ID NO: 39 - protein, 9 aa, synthetic construct
  REGION 1..9: note = Description of Artificial Sequence: Synthetic peptide
PAAKKKKLD

SEQ ID NO: 40-41 - skipped (2 entries)

SEQ ID NO: 42 - protein, 1362 aa, synthetic construct
  REGION 1..1362: note = Description of Artificial Sequence: Synthetic polypeptide
MGHHHHHHSSGLVPRGSGTMKNMESFINLYPVSKTLRFELKPIGKTLETFSRWIEELKEKEAIELKETGNLLAQDEHRAESYKKVKKILDEYHKWFITESLQNTKLNGLDVFYHNYMLPKKEDHEKKAFASCQDNLRKQIVNAFRQETGLFNKLSGKELFKDSKEEVALLKAIVPYFDNKTLENIGVKSNEGALLLIEEFKDFTTYFGGFHENRKNMYSDEAKSTAVAFRLIHENLPRFIDNKKVFEEKIMNSELKDKFPEILKELEQILQVNEIEEMFQLDYFNDTLIQNGIDVYNHLIGGYAEEGKKKIQGLNEHINLYNQIQKEKNKRIPRLKPLYKQILSDRETASFVIEAFENDGELLESLEKSYRLLQQEVFTPEGKEGLANLLAAIAESETHKIFLKNDLGLTEISQQIYESWSLIEEAWNKQYDNKQKKVTETETYVDNRKKAFKSIKSFSIAEVEEWVKALGNEKHKGKSVATYFKSLGKTDEKVSLIEQVENNYNIIKDLLNTPYPPSKDLAQQKDDVEKIKNYLDSLKALQRFIKPLLGSGEESDKDAHFYGEFTAFWDVLDKVTPLYNKVRNYMTKKPYSTEKFKLNFENSYFLNGWAQDYETKAGLIFLKDGNYFLAINNKKLDEKEKKQLKTNYEKNPAKRIILDFQKPDNKNIPRLFIRSKGDNFAPAVEKYNLPISDVIDIYDEGKFKTEYRKINEPEYLKSLHKLIDYFKLGFSKHESYKHYSFSWKKTHEYENIAQFYHDVEVSCYQVLDENINWDSLMEYVEQNKLYLFQIYNKDFSPNSKGTPNMHTLYWKMLFNPDNLKDVVYKLNGQAEVFYRKASIKKENKIVHKANDPIDNKNELNKKKQNTFEYDIVKDKRYTVDKFQFHVPITLNFKAEGLNNLNSKVNEYIKECDDLHIIGIDRGERHLLYLSLIDMKGNIVKQFSLNEIVNEHKGNTYRTNYHNLLDKREKEREKERESWKTIETIKELKEGYISQVVHKITQLMIEYNAIVVLEDLNFGFKRGRFKVEKQVYQKFEKMLIDKLNYLVDKKKEANESGGTLKAYQLTDSYADFMKYKKKQCGFLFYVPAWNTSKIDPTTGFVNLFDTHYVNVSKAQEFFSKFKSIRYNAANNYFEFEVTDYFSFSGKAEGTKQNWIICTHGTRIINFRNPEKNSQWDNKEVVITDEFKKLFEKHGIDYKNSSDLKGQIASQSEKAFFHNEKKDTKDPDGLLQLFKLALQMRNSFIKSEEDYLVSPVMNDEGEFFDSRKAQPNQPENADANGAYNIAMKGKWVVKQIRESEDLDKLKLAISNKEWLNFAQRSAAAKRPAATKKAGQAKKKKASGSGAGSPKKKRKVEDPKKKRKV

SEQ ID NO: 43 - DNA, 4092 bp, synthetic construct
  misc_feature 1..4092: note = Description of Artificial Sequence: Synthetic polynucleotide
  source 1..4092: mol_type = other DNA
atgggccaccatcatcatcatcatagcagcggcctggtgccgcgcggcagcggtaccatgaagaacatggagtcttttattaatttatatccggtttcgaaaactttacgttttgagttaaagcctattggcaaaacactcgaaactttctcccgctggatcgaagagttgaaagagaaagaggctattgagctgaaagaaactggcaacctgttggcgcaggatgagcatcgggccgagtcttataagaaggtcaaaaaaattcttgacgaatatcataaatggttcatcactgaaagcctccagaacacaaagttaaatgggttggacgttttttatcataactatatgctcccgaagaaagaggaccatgagaagaaagcttttgcttcgtgtcaagataatctccgtaagcaaattgtaaacgcgtttcgtcaagaaaccggtttatttaacaaactgtcaggcaaagaactgtttaaagattcgaaggaagaggttgcactgttgaaagccattgtaccgtatttcgataacaagactctggaaaacattggtgttaagagtaatgaaggggctctccttttaattgaagagttcaaggattttaccacgtatttcggtggcttccatgagaatcgcaaaaatatgtatagcgacgaagcaaaatcaacagcggttgcctttcgtcttattcacgaaaatttgccgcgcttcattgacaataagaaggtcttcgaagagaaaatcatgaatagtgaattaaaggataaatttccagagattttgaaggagctggaacagattctgcaagtcaacgagattgaagagatgtttcagctcgactattttaacgacacattgatccagaatggcatcgatgtctataaccatttgatcggcggctacgccgaggaaggcaagaaaaaaattcaagggcttaacgagcatattaacctctataaccagatccagaaggagaagaataagcgtatcccgcggctgaaaccactctataagcaaattttgagtgatcgcgaaaccgcctcatttgttatcgaggcgtttgagaacgatggcgagttattagaatcattggagaagtcatatcgcttactgcagcaggaggtctttacgcctgaaggtaaagaaggtctggcgaatttactcgcagcaatcgctgaaagcgagacacacaagatctttctgaagaacgacttgggtctcaccgagatctctcaacaaatttatgaatcatggtcgctgattgaagaggcatggaataaacaatatgacaacaaacagaagaaagttacggagacagagacatatgtggacaatcggaaaaaggctttcaagtccatcaagagctttagcatcgcagaggttgaggaatgggtgaaagcacttgggaatgagaaacacaagggcaaaagcgtggcaacctattttaaaagtctcgggaagactgacgaaaaagttagccttattgaacaggtagagaacaattataatatcatcaaggaccttttgaacacaccgtatcctccttcgaaggacttggcccagcaaaaagatgacgttgaaaaaatcaaaaattatttggactctctgaaggccctccagcggttcattaagccattgttgggtagcggggaggaatccgataaagatgcgcacttttatggtgagtttaccgctttctgggatgtgctcgacaaagtaaccccactctacaataaagtccgcaactatatgactaagaaaccttatagcacagagaaatttaagctgaattttgaaaatagttactttttgaatggttgggcacaggactacgagacaaaagcggggcttatcttcttgaaggacggcaattacttccttgccatcaataataagaaattagatgaaaaggagaaaaaacagctcaagactaattatgagaagaatcctgcgaagcgtatcatcttagactttcagaagccagacaataagaacattcctcgcttgttcattcgcagtaaaggcgacaatttcgctcctgcagtagaaaagtataatcttccgatctctgacgttattgacatctatgacgaggggaagtttaagactgagtatcgcaaaattaacgagccggaatatctcaaatctctccataagctgattgactacttcaaacttgggttctccaagcatgaatcctacaagcattattctttttcatggaagaaaacacatgagtatgagaacatcgcccagttttaccacgacgtggaggtctcttgctatcaggtgctcgacgaaaatattaactgggattccctcatggagtatgtagaacagaacaaattgtacttgttccagatttataacaaagacttctccccaaactcgaaaggcactccgaatatgcacactttgtactggaagatgttgtttaatccggataatcttaaggacgtggtctataagctgaacggtcaggctgaagtattctaccggaaggcgagtattaagaaagaaaacaagattgtccacaaggcgaacgaccctattgacaataaaaacgagttgaataagaaaaagcaaaatacatttgaatacgacatcgtcaaagataaacggtatacagtggataagtttcaattccatgttcctatcacgctcaactttaaagctgaaggcctgaataacttgaatagcaaagttaacgaatacatcaaagagtgtgacgaccttcacattattggcatcgaccggggtgaacggcacctcttgtatctgagcctcatcgatatgaaaggtaacattgtaaagcaatttagtcttaacgagatcgttaatgagcacaaggggaacacgtaccgcacgaactatcataacctcttggacaaacgtgaaaaggaacgtgaaaaagagcgcgagtcatggaaaaccattgagaccatcaaagagctgaaagaaggctatattagtcaagtagtacataaaatcactcagttaatgatcgaatataatgcgatcgttgtactcgaagacctgaatttcggcttcaaacgcggccggttcaaggtggagaagcaagtgtatcaaaaatttgagaagatgttaattgataaactgaactacttggtcgataagaagaaggaagccaatgagagtggcgggacactcaaagcctaccagcttaccgatagttacgctgacttcatgaagtacaagaaaaagcaatgcggcttcctgttttatgtcccggcctggaacacttccaaaatcgatcctactactgggttcgtgaatctgtttgacacacattatgtcaatgttagtaaggcccaggaatttttctcgaaattcaagtcaattcgctacaacgcggccaacaactatttcgagtttgaagtaacagattatttttccttcagtggtaaagctgagggcaccaagcagaattggatcatttgcacccatggcacccgcattatcaattttcgtaacccggaaaaaaattcgcagtgggataataaggaagtagtgatcacagatgaattcaagaaactgtttgagaagcacggcattgactacaaaaatagttccgacctcaaggggcagatcgcctctcaatcggagaaggcgttttttcataacgaaaaaaaagatacaaaggacccagatggccttctgcagctttttaaactggcgctgcagatgcggaactctttcattaagagcgaagaggactacttagtatctcctgtgatgaacgacgaaggtgaattctttgactcgcgcaaagcccagcctaatcagccagagaacgctgatgctaatggggcgtacaatattgcaatgaaagggaaatgggttgttaagcaaatccgcgaatcggaggacctcgacaagctgaaactggcaatctcaaataaagaatggttgaacttcgcccagcgctccgcggccgcaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 44-50 - skipped (7 entries)

SEQ ID NO: 51 - DNA, 21 bp, synthetic construct
  misc_feature 1..21: note = Description of Artificial Sequence: Synthetic oligonucleotide
  source 1..21: mol_type = other DNA
aggatgtggtccccatgaact

SEQ ID NO: 52 - DNA, 21 bp, synthetic construct
  misc_feature 1..21: note = Description of Artificial Sequence: Synthetic oligonucleotide
  source 1..21: mol_type = other DNA
ctcacgtcatccagcagagaa

SEQ ID NO: 53 - DNA, 21 bp, synthetic construct
  misc_feature 1..21: note = Description of Artificial Sequence: Synthetic oligonucleotide
  source 1..21: mol_type = other DNA
ctcttcctcctactcaccatc

SEQ ID NO: 54 - DNA, 21 bp, synthetic construct
  misc_feature 1..21: note = Description of Artificial Sequence: Synthetic oligonucleotide
  source 1..21: mol_type = other DNA
taggggccccaactccatggt

SEQ ID NO: 55 - protein, 1314 aa, synthetic construct
  REGION 1..1314: note = Description of Artificial Sequence: Synthetic polypeptide
MGHHHHHHSSGLVPRGSGTMKNILEQFVGLYPLSKTLRFELKPLGKTLEHIEKKGLIAQDEQRAEEYKLVKDIIDRYHKAFIHMCLKHFKLKMYSEQGYDSLEEYRKLASISKRNEKEEQQFDKVKENLRKQIVDAFKNGGSYDDLFKKELIQKHLPRFIEGEEEKRIVDNFNKFTTYFTGFHENRKNMYSDEKESTAIAYRLIHENLPLFLDNMKSFAKIAESEVAARFTEIETAYRTYLNVEHISELFTLDYFSTVLTQEQIEVYNNIIGGRVDDDNVKIQGLNEYVNLYNQQQKDRSKRLPLLKSLYKMILSDRIAISWLPEEFKSDKEMIEAINNMHDDLKDILAGDNEDSLKSLLQHIGQYDLSKIYIANNPGLTDISQQMFGCYDVFTNGIKQELRNSITPSKKEKADNEIYEERINKMFKSEKSFSIAYLNSLPHPKTDAPQKNVEDYFALLGTCNQNDEQPINLFAQIEMARLVASDILAGRHVNLNQSENDIKLIKDLLDAYKALQHFVKPLLGSGDEAEKDNEFDARLRAAWNALDIVTPLYNKVRNWLTRKPYSTEKIKLNFENAQLLGGWDQNKEPDCTSVLLRKDGMYYLAIMDKKANHAFDCDCLPSDGACFEKIDYKLLPGANKMLPKVFFSKSRIKEFSPSESIIAAYKKGTHKKGPNFSLSDCHRLIDFFKASIDKHEDWSKFRFRFSDTKTYEDISGFYREVEQQGYMLGFRKVSEAFVNKLVDEGKLYLFHIWNKDFSKHSKGTPNLHTIYWKMLFDEKNLTDVIYKLNGQAEVFYRKKSLDLNKTTTHKAHAPITNKNTQNAKKGSVFDYDIIKNRRYTVDKFQFHVPITLNFKATGRNYINEHTQEAIRNNGIEHIIGIDRGERHLLYLSLIDLKGNIVKQMTLNDIVNEYNGRTYATNYKDLLATREGERTDARRNWQKIENIKEIKEGYLSQVVHILSKMMVDYKAIVVLEDLNTGFMRNRQKIERQVYEKFEKMLIDKLNCYVDKQKDADETGGALHPLQLTNKFESFRKLGKQSGWLFYIPAWNTSKIDPVTGFVNMLDTRYENADKARCFFSKFDSIRYNADKDWFEFAMDYSKFTDKAKDTYTWWTLCSYGTRIKTFRNPAKNNLWDNEEVVLTDEFKKVFAAAGIDVHENLKEAICALTDKKYLEPLMRLMTLLVQMRNSATNSETDYLLSPVADESGMFYDSREGKETLPKDADANGAYNIARKGLWTIRRIQATNCEEKVNLVLSNREWLQFAQQKPYLNDAAAKRPAATKKAGQAKKKKASGSGAGSPKKKRKVEDPKKKRKV

SEQ ID NO: 56 - DNA, 3948 bp, synthetic construct
  misc_feature 1..3948: note = Description of Artificial Sequence: Synthetic polynucleotide
  source 1..3948: mol_type = other DNA
atgggccaccatcatcatcatcatagcagcggcctggtgccgcgcggcagcggtaccatgaagaacatcttagagcagtttgtcggcttatatccgttgtctaaaacacttcggtttgagcttaaacctttgggtaagacgttggaacatattgagaaaaaaggcttgattgcccaagacgaacagcgggcggaggagtacaaattggttaaagatattattgatcgctaccacaaggcttttattcatatgtgcttaaaacattttaagctcaagatgtacagtgaacaagggtatgatagcttggaggagtaccgcaagcttgcgtcaatttccaaacgcaacgagaaagaggagcagcaatttgacaaagtcaaggaaaatcttcgtaagcaaattgtcgacgcgtttaaaaatggcgggagttatgatgatctgtttaagaaagaattgatccagaaacacctcccacgttttattgagggtgaagaagaaaaacgtatcgttgacaacttcaacaagttcacgacctattttactggttttcatgaaaatcgcaagaatatgtatagtgacgaaaaggaatcgacggctattgcttatcgtctcattcacgaaaacttgccattgtttttggataacatgaagagcttcgctaagatcgccgaatcggaagtggctgctcgttttaccgaaatcgaaaccgcttaccggacatacttgaacgtagaacacattagtgaactgttcaccctcgactattttagcacggttttgacgcaagaacaaatcgaagtatataataacattatcggcgggcgcgtcgacgacgacaacgtaaagatccaagggttgaatgagtacgtaaatttatataatcagcagcagaaggaccggtctaagcgcttaccgcttcttaagtccctctacaaaatgatcttatccgatcgtattgcaatttcgtggttacctgaggagttcaaatccgataaggagatgattgaagcaattaacaacatgcatgacgacctgaaggacattctggcaggcgacaacgaagactcgcttaagtccttactgcagcatattggccaatacgatctctcgaaaatctacattgcgaacaatccgggcctgacagatatctcacaacaaatgttcgggtgttatgacgtctttactaatgggatcaagcaggagctccggaacagtattaccccttcaaaaaaggagaaagccgataacgaaatctacgaggagcggattaacaaaatgtttaaaagtgagaagagtttctcaattgcctacctgaattcgttgccgcacccaaagacggatgcgcctcaaaaaaatgttgaggattattttgctctcctggggacttgcaatcaaaacgatgaacagccgattaatttgtttgcccaaattgagatggcacgcttagtcgcctctgatattctcgcaggccggcacgttaatttgaaccaatctgagaatgatatcaagttaatcaaggatctgttagatgcttacaaggctctgcagcatttcgtcaaaccactccttggctcgggtgacgaggctgagaaagataacgagttcgatgcacgcctccgtgcggcttggaatgcgttggacattgttacaccactctataacaaggttcggaactggctgacccgcaaaccatattctacagaaaaaatcaagcttaatttcgaaaacgcccaacttctggggggttgggatcagaacaaagaaccggattgcacatcagtcctccttcggaaggatgggatgtactatttagcgatcatggataaaaaggcgaatcacgcctttgactgtgactgcttaccgtctgacggggcctgtttcgagaaaattgactacaagctgctcccgggcgcgaataaaatgttgccgaaagtttttttttctaaaagccgcatcaaagaattttccccttcggaatcgatcatcgctgcttataaaaaggggactcataaaaaagggccgaatttcagtctctctgattgtcatcgcttgattgacttttttaaggctagcattgataagcacgaagattggtcaaaatttcgttttcgcttctcagataccaaaacgtatgaagacatcagtggtttctaccgtgaagtagaacagcaaggctatatgctgggttttcgtaaagtctctgaggcctttgtgaataaactcgttgatgaaggtaagttatacttattccatatctggaacaaagactttagtaagcactccaaaggtacacctaatctccacactatttattggaaaatgctcttcgatgagaaaaatctcactgacgtcatctacaaactgaatgggcaggctgaagtattctaccgtaaaaaaagtctggatcttaataagacaactactcacaaggcacatgccccaatcaccaataaaaatacccaaaacgcaaagaagggtagtgttttcgattacgatatcatcaaaaatcgtcgctacacagtggacaaattccagttccacgtccctatcaccttaaattttaaggcaacaggtcgtaattacattaatgagcacactcaagaggcaatccgtaataatggcatcgaacatatcattggcatcgaccgtggggagcgtcacttgctttacttgtcgctcattgatctgaagggtaatatcgtcaagcagatgacccttaatgatattgtcaatgaatataatggtcggacttatgcgacgaactacaaggacttgctggcaacacgggagggtgagcgtacggacgctcggcgcaactggcagaagattgaaaatattaaagaaatcaaggaaggttaccttagccaggtggtgcacatcttgagtaaaatgatggtcgactacaaggctatcgttgttctggaagacttgaatacaggcttcatgcggaatcgtcaaaaaatcgaacgtcaagtatatgagaagttcgaaaaaatgttaattgacaagctgaactgctatgttgacaaacaaaaggatgctgacgagacgggcggtgccctccacccgctgcagctgacaaacaaatttgagtcgtttcgtaagttaggtaagcagagtggttggcttttttacatcccagcatggaacacttcgaaaatcgacccagttactgggttcgtgaacatgttagacacgcgctacgagaacgccgataaggcgcggtgtttcttctcgaaattcgattccatccggtataacgctgacaaagattggtttgagtttgctatggattacagtaagttcactgataaagcgaaagatacttacacgtggtggactctgtgttcctatgggacgcgtattaaaacttttcgtaatccggctaagaataatttgtgggataatgaggaggttgtccttactgatgagttcaagaaagttttcgcagcggcaggtattgatgtccatgagaaccttaaggaagcgatctgtgctctgacagataaaaagtatcttgaaccactcatgcgtctcatgaccctgctcgttcaaatgcggaactctgctactaactccgaaacagactatttactttcaccagttgctgacgagtcagggatgttctatgactcccgcgaagggaaggaaacactgccaaaagatgcggacgccaacggtgcatataacattgcccgtaagggcctctggaccatccggcggattcaagccaccaactgtgaggagaaagttaacttagtcctcagtaatcgtgaatggttgcagtttgcccagcagaaaccatatctgaatgatgcggccgcaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 57 - DNA, 21 bp, synthetic construct
  misc_feature 1..21: note = Description of Artificial Sequence: Synthetic oligonucleotide
  source 1..21: mol_type = other DNA
gtgttgctggtgagtgtgcat

SEQ ID NO: 58 - DNA, 21 bp, synthetic construct
  misc_feature 1..21: note = Description of Artificial Sequence: Synthetic oligonucleotide
  source 1..21: mol_type = other DNA
cttgtaagtagtagcagcagc

SEQ ID NO: 59 - DNA, 21 bp, synthetic construct
  misc_feature 1..21: note = Description of Artificial Sequence: Synthetic oligonucleotide
  source 1..21: mol_type = other DNA
gggtgcatacctgtctggctg

SEQ ID NO: 60 - DNA, 21 bp, synthetic construct
  misc_feature 1..21: note = Description of Artificial Sequence: Synthetic oligonucleotide
  source 1..21: mol_type = other DNA
tctgcagggacaataggagcc

SEQ ID NO: 61 - DNA, 21 bp, synthetic construct
  misc_feature 1..21: note = Description of Artificial Sequence: Synthetic oligonucleotide
  source 1..21: mol_type = other DNA
tatgacctgtatggaggggag

SEQ ID NO: 62 - DNA, 21 bp, synthetic construct
  misc_feature 1..21: note = Description of Artificial Sequence: Synthetic oligonucleotide
  source 1..21: mol_type = other DNA
aggccttacctgaggcgaggg

SEQ ID NO: 63 - DNA, 21 bp, synthetic construct
  misc_feature 1..21: note = Description of Artificial Sequence: Synthetic oligonucleotide
  source 1..21: mol_type = other DNA
tgagggtgaaggatagacgct

SEQ ID NO: 64 - DNA, 21 bp, synthetic construct
  misc_feature 1..21: note = Description of Artificial Sequence: Synthetic oligonucleotide
  source 1..21: mol_type = other DNA
actttccattctctgctggat

SEQ ID NO: 65 - DNA, 21 bp, synthetic construct
  misc_feature 1..21: note = Description of Artificial Sequence: Synthetic oligonucleotide
  source 1..21: mol_type = other DNA
tggcctggaggctatccagcg

SEQ ID NO: 66 - DNA, 21 bp, synthetic construct
  misc_feature 1..21: note = Description of Artificial Sequence: Synthetic oligonucleotide
  source 1..21: mol_type = other DNA
tatctcttgtactacactgaa

SEQ ID NO: 67 - DNA, 21 bp, synthetic construct
  misc_feature 1..21: note = Description of Artificial Sequence: Synthetic oligonucleotide
  source 1..21: mol_type = other DNA
cctggagatgcatactcacac

SEQ ID NO: 68 - protein, 1333 aa, synthetic construct
  REGION 1..1333: note = Description of Artificial Sequence: Synthetic polypeptide
MGHHHHHHSSGLVPRGSGTMIYRENFKRKKEKIEMNTGFNDFTNLSSVTKTLCNRLIPTEITAKYIKEHGVIEADQERNMMSQELKNILNDFYRSFLNENLVKVHELDFKPLFTEMKKYLETKDNKEALEKAQDDMRKAIHDIFESDDRYKKMFKAEITASILPEFILHNGAYSAEEKEEKMQVVKMFNGFMTSFSAFFTNRENCFSKEKISSSACYRIVDDNAKIHFDNIRIYKNIANKFDYEIEMIEKIEEAAGGADIRNIFSYNFDHFAFNHFVSQDDISFYNYVVGGINKFMNLYCQATKEKLSPYKLRHLHKQILCIEESLYDVPAKFNCDEDVYAAVNDFLNNVRTKSVIERLQMLGKNADSYDLDKIYISKKHFTNISQTLYRDFSVINTALTMSYIDTLPGKGKTKEKKAASMAKNTELISLGEIDKLVDKYNLCPDKAASTRSLIRSISDIVADYKANPLTMNSGIPLAENETEIAVLKEAIEPFMDIFRWCAKFKTDEPVDKDTDFYTELEDINDEIHSIVSLYNRTRNYVTKKPYNTDKFGLYFGTSSFASGWSESKEFTNNAILLAKDDKFYLGVFNAKNKPAKSIIKGHDTIQDGDYKKMVYSLLTGPNKMLPHMFISSSKAVPVYGLTDELLSDYKKGRHLKTSKNFDIDYCHKLIDYFKHCLALYTDWDCFNFKFSDTESYNDIGEFYKEVAEQGYYMNWTYIGSDDIDSLQENGQLYLFQIYNKDFSEKSFGKPSKHTAILRSLFSDENVADPVIKLCGGTEVFFRPKSIKTPVVHKKGSILVSKTYNAQEMDENGNIITVRKCVPDDVYMELYGYYNNSGTPLSAEALKYKDIVDHRTAPYDIIKDRRYTEDEFFINMPVSLNYKAENRRVNVNEMALKYIAQTKDTYIIGIDRGERNLLYVSVIDTDGNIVEQKSLNIINNVDYQAKLKQVEIMRKLARQNWKQGVKIADLKKGYLSQAVHEVAELVIKYNGIVVMEDLNSRFKEKRSKIERGVYQQFETSLIKTLNYLTFKDRKPLEAGGIANGYQLTYIPESLKNVGSQCGCILYVPAAYTSKIDPTTGFVTLFKFKDISSEKAKTDFIGRFDCIRYDAEKDLFAFEFDYDNFETYETCARTKWCAYTYGTRVKKTFRNRKFVSEVIIDITEEIKKTLAATDINWIDSHDIKQEIIDYALSSHIFEMFKLTVQMRNSLCESKDREYDKFVSPILNASGKFFDTDAADKSLPIEADANDAYGIAMKGLYNVLQVKNNWAEGEKFKFSRLSNEDWFNFMQKRAAAKRPAATKKAGQAKKKKASGSGAGSPKKKRKVEDPKKKRKV

SEQ ID NO: 69 - DNA, 4005 bp, synthetic construct
  misc_feature 1..4005: note = Description of Artificial Sequence: Synthetic polynucleotide
  source 1..4005: mol_type = other DNA
atgggccaccatcatcatcatcatagcagcggcctggtgccgcgcggcagcggtaccatgatctaccgtgagaattttaagcggaaaaaggagaagattgaaatgaacactgggtttaatgacttcactaatttgagttccgtgaccaagacgttatgcaaccggttgatcccaacagaaattaccgcaaagtacattaaggagcatggggtaattgaggcggaccaagaacggaacatgatgagtcaagagctgaaaaatatcttgaatgacttttaccggagtttcctgaacgagaaccttgtgaaggtgcacgaacttgatttcaagccgttattcaccgagatgaaaaagtacctcgaaacaaaagataacaaggaagcactcgaaaaggcccaggacgacatgcggaaggcaatccatgatatctttgaaagtgatgaccgctacaaaaaaatgttcaaggctgagatcacggcgtcgattttgcctgaattcattcttcataacggggcatattcagccgaagaaaaggaggagaaaatgcaagtagtcaagatgttcaatggctttatgacgtctttctcagcattctttacgaatcgtgagaattgtttctccaaagaaaagatcagctcctccgcatgttaccgtattgttgatgacaacgcgaaaatccatttcgataacattcgtatttataaaaatatcgccaacaagttcgattatgaaattgaaatgatcgagaagatcgaagaggcggcggggggtgccgacattcgtaatatcttctcgtacaactttgaccactttgcattcaatcatttcgttagtcaagatgatatctcattctacaattatgttgttggtggtattaacaagtttatgaacttgtattgtcaagccaccaaagagaaattatcgccttataaactgcgtcaccttcacaaacagattctgtgtattgaggaaagcctctatgacgtgccagcgaagtttaattgtgatgaggacgtatatgcagctgtcaacgattttcttaataacgttcggacgaaatcagtaattgaacgcttgcaaatgctcggcaaaaatgcagacagttacgacctggataaaatttatatctctaaaaagcacttcaccaatatctctcaaactttatatcgcgacttctctgtgatcaacactgccctcactatgtcttatatcgatactcttccgggtaaggggaaaaccaaggaaaaaaaggcagcatcgatggccaaaaacaccgaacttatttcgttaggcgaaattgataagttggtggataaatataacctctgtccagataaggcagctagcactcgtagcctcattcggtctattagcgacatcgtcgctgactacaaggcaaaccctcttacaatgaatagtgggattccgttggcagagaacgagacagaaatcgcggtgttaaaagaggcgatcgagccttttatggatatcttccggtggtgtgctaagtttaaaaccgacgagcctgtcgataaggatacagatttctacacggagttagaagacattaacgatgaaatccatagtattgtcagtctttataaccggacccggaattatgtcactaaaaagccgtacaacacagataagttcggtctgtattttggcacttcgtcgttcgcatcgggttggagcgagagcaaagagtttactaacaacgcaattttgttagccaaggatgacaagttttacctcggcgtgttcaacgcaaaaaacaagccagcaaaatcgattatcaaagggcatgacacaatccaagatggtgattataagaaaatggtgtattcactgctcaccgggccaaataagatgcttcctcacatgtttatctcgagcagtaaagcggttcctgtttacgggctcactgacgagcttctcagcgactataagaaaggtcgccaccttaagacatccaagaatttcgacattgattactgtcacaaacttatcgattacttcaaacattgtctcgctttgtatactgattgggattgcttcaacttcaaattctctgatacggagtcctacaatgatatcggcgagttctacaaagaggttgccgagcaaggctactacatgaactggacatatatcgggtcggacgatatcgattcgctgcaggaaaacggccagctctatctttttcaaatttataacaaagatttcagcgaaaagtcattcggtaaaccgtctaaacatacggccatcctgcgtagcttattcagcgatgaaaacgtggccgacccagtcattaaactgtgtggggggaccgaagtttttttccggccgaagtctattaagacaccagtagtacataaaaaaggcagcatcctcgtatccaaaacctataacgcacaagaaatggacgagaatggtaatatcatcaccgtgcggaagtgtgttccagacgacgtctatatggagctctacggctattacaacaactctgggacgcctctgtccgccgaagctttgaaatacaaggatattgtggaccaccgcacggctccgtacgacattatcaaggaccggcgttacaccgaagacgaatttttcatcaacatgccggtgtcattgaattataaagcggaaaaccgccgtgttaatgtgaacgaaatggccttaaaatacatcgcacagaccaaggacacctacatcattggcatcgatcggggcgaacgtaatctgttgtatgtgagcgttatcgatactgacggcaatatcgttgagcaaaagagtctcaatatcatcaataacgtggattatcaagccaaattaaagcaagtggaaatcatgcgtaaactggcccgtcagaattggaagcagggggtaaagattgcagacctgaaaaagggctacctgtcacaagcggtacatgaagtcgcggaacttgtaattaaatacaacgggattgttgtaatggaggacttaaactcccgcttcaaagagaagcgttctaaaattgaacgcggcgtctaccaacagtttgagacatcattaatcaagacattgaattatttgacgttcaaagatcgcaaaccgttagaagccgggggcattgcgaatggttatcaattaacttatattccggagtctcttaaaaatgtgggctctcagtgcggctgtatcttgtatgtgccagcagcctacacctcgaagatcgaccctaccactggtttcgtcaccttgttcaaattcaaagacatttcgagcgagaaagctaaaacggattttattggtcggttcgactgcatccgttatgatgcagaaaaggaccttttcgcatttgaattcgattatgacaactttgagacttatgagacttgtgcgcgtaccaaatggtgtgcatatacatacgggactcgggtgaagaaaactttccggaatcggaaattcgtgtcagaggtgatcatcgacatcactgaagagatcaagaagacccttgcagcgaccgatattaattggattgacagtcacgacatcaaacaagagatcatcgactatgcccttagcagccatatttttgaaatgttcaaattaacggtacagatgcgtaacagcctttgcgagagtaaagatcgcgagtacgacaagttcgtctcacctattctcaacgcgtcgggcaaatttttcgacaccgatgccgctgataaaagtctgcctattgaagctgatgcgaacgatgcgtatggtattgctatgaaagggttgtataatgttttacaagtcaaaaacaactgggcggagggcgagaaatttaagttctcccgtttaagcaacgaagattggttcaacttcatgcaaaagcgggcggccgcaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 70 - DNA, 21 bp, synthetic construct
  misc_feature 1..21: note = Description of Artificial Sequence: Synthetic oligonucleotide
  source 1..21: mol_type = other DNA
tgtgtgagtatgcatctccag

SEQ ID NO: 71 - DNA, 21 bp, synthetic construct
  misc_feature 1..21: note = Description of Artificial Sequence: Synthetic oligonucleotide
  source 1..21: mol_type = other DNA
tcagccagctctgaggggacc

SEQ ID NO: 72 - DNA, 21 bp, synthetic construct
  misc_feature 1..21: note = Description of Artificial Sequence: Synthetic oligonucleotide
  source 1..21: mol_type = other DNA
ctcacaacagctgcagggaag

SEQ ID NO: 73 - DNA, 21 bp, synthetic construct
  misc_feature 1..21: note = Description of Artificial Sequence: Synthetic oligonucleotide
  source 1..21: mol_type = other DNA
agcttgccattcagagaggca

SEQ ID NO: 74 - DNA, 21 bp, synthetic construct
  misc_feature 1..21: note = Description of Artificial Sequence: Synthetic oligonucleotide
  source 1..21: mol_type = other DNA
tacatacctgtcactatacac

SEQ ID NO: 75 - DNA, 21 bp, synthetic construct
  misc_feature 1..21: note = Description of Artificial Sequence: Synthetic oligonucleotide
  source 1..21: mol_type = other DNA
tttttctagatgtgaacatgg

SEQ ID NO: 76 - DNA, 21 bp, synthetic construct
  misc_feature 1..21: note = Description of Artificial Sequence: Synthetic oligonucleotide
  source 1..21: mol_type = other DNA
atgattccatgttcacatcta

SEQ ID NO: 77 - DNA, 21 bp, synthetic construct
  misc_feature 1..21: note = Description of Artificial Sequence: Synthetic oligonucleotide
  source 1..21: mol_type = other DNA
gtgtaacatacctggaggaca

SEQ ID NO: 78 - DNA, 21 bp, synthetic construct
  misc_feature 1..21: note = Description of Artificial Sequence: Synthetic oligonucleotide
  source 1..21: mol_type = other DNA
ggaggattgctcaacaaccat

SEQ ID NO: 79 - DNA, 21 bp, synthetic construct
  misc_feature 1..21: note = Description of Artificial Sequence: Synthetic oligonucleotide
  source 1..21: mol_type = other DNA
taggaaacagtggcaataaat

SEQ ID NO: 80 - DNA, 21 bp, synthetic construct
  misc_feature 1..21: note = Description of Artificial Sequence: Synthetic oligonucleotide
  source 1..21: mol_type = other DNA
caaggatgcttaccaccaggg

SEQ ID NO: 81 - protein, 1297 aa, synthetic construct
  REGION 1..1297: note = Description of Artificial Sequence: Synthetic polypeptide
MGHHHHHHSSGLVPRGSLQMTMDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKLLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLINAAAKRPAATKKAGQAKKKKASGSGAGSPKKKRKVEDPKKKRKV

SEQ ID NO: 82 - DNA, 3897 bp, synthetic construct
  misc_feature 1..3897: note = Description of Artificial Sequence: Synthetic polynucleotide
  source 1..3897: mol_type = other DNA
atgggccaccatcatcatcatcatagcagcggcctggtgccgcgcggcagcctgcagatgacaatggattacggtaacggtcaatttgagcggcgcgccccgctcaccaagacaatcactctccggttgaaaccgatcggggagacccgtgagacgattcgcgagcaaaagctcctcgaacaagatgctgcattccgtaaacttgttgaaactgtcacccctatcgtggatgattgtatccggaaaattgctgacaacgctttgtgtcattttggcacggaatatgatttctcctgtttaggtaatgccatctcaaaaaatgacagcaaagcgattaagaaagagaccgaaaaagtagagaagctgttggccaaggttctgacagagaacttgccagacggtctgcgtaaagtcaacgatattaacagcgcggcttttattcaggacacactgacatcattcgtccaggacgatgctgacaaacgtgtgttaattcaagagttaaagggcaaaactgtgttaatgcaacgctttttaacaacccggattactgcattgactgtatggctccctgaccgggtgtttgagaacttcaacatttttatcgaaaatgctgaaaagatgcgcatcttgctcgactcaccattgaatgaaaagatcatgaagttcgatccggatgctgaacaatacgcgagtttggaattctatggtcaatgtctgtcccagaaggatattgattcgtacaacctcatcatttccgggatttatgccgatgatgaggtcaagaacccaggtatcaatgaaattgttaaggaatacaaccagcaaattcgcggggataaggatgagtcacctttacctaaactgaaaaagttgcataaacaaattttgatgcctgtcgagaaggcatttttcgttcgggtactcagtaatgattctgatgctcgttcaattttagaaaaaatcttgaaggatactgagatgttgccttctaagatcattgaagcgatgaaagaagcagacgctggggacatcgctgtatatggttcacgtttgcacgagttaagccacgtaatctatggcgatcacgggaagctctctcagattatctatgataaggagtcgaaacgcatcagcgagctcatggaaacgttatcgcctaaggagcgcaaagagtcaaagaaacgcttggagggtctggaagaacatatccggaagtcgacatataccttcgacgagcttaatcgttatgcggaaaagaacgtcatggctgcctacatcgcggccgtggaggaaagctgcgccgaaattatgcgtaaggagaaggacttacgcacgcttcttagtaaggaggatgtcaagattcgtggtaatcgccacaatacgttaattgttaagaactacttcaatgcctggactgtcttccggaatttgatccgcatcctccggcggaaatccgaggcggagatcgactcagatttctatgacgtcttggatgactctgtggaagttttatcgctcacatataaaggtgaaaacttgtgccggtcttacattacgaagaagatcgggagcgatttaaagccagagattgctacctatggttccgccttgcgccctaattcacggtggtggtcaccgggcgagaagtttaacgtaaagttccacaccattgttcgccgggacggtcgcctttattatttcatcttgccgaaaggtgccaaacctgtcgagctcgaagatatggatggggacatcgaatgcttgcaaatgcgcaagattccgaatccgactattttccttccaaaattggttttcaaggacccagaggccttcttccgcgacaatccagaggcagatgaattcgtttttctttcgggtatgaaagctccagtgaccatcacgcgtgaaacctatgaggcgtatcgctacaaactttatacagttgggaagttacgcgacggtgaagtgagcgaagaagagtataaacgtgcgttgttacaagtattgaccgcctataaggaattcttagagaatcggatgatctacgcagatctgaactttggctttaaagatctcgaagaatacaaagactcgtcagaatttatcaaacaagtcgaaactcacaacacttttatgtgctgggctaaggtcagtagcagtcagctcgacgacctggtcaagagcgggaacgggttactgttcgaaatctggtcagaacggttggagtcctattacaaatatggcaacgagaaggtgctgcgtgggtacgagggcgttcttttgagtatccttaaggacgagaacctcgtgagcatgcggacgctgcttaattctcggccgatgctcgtctaccgccctaaagaatcatccaagccgatggtcgttcaccgggacggtagccgcgtcgttgatcggttcgataaggatgggaagtatattccaccagaggtacacgacgaattataccggttctttaacaatttgcttattaaggaaaagctcggcgagaaagcgcgcaaaattttagacaacaaaaaagtaaaagtaaaggtattggaatctgaacgtgtaaagtggtcaaagttttatgatgaacagtttgcagttacattctctgttaaaaagaatgcagactgtctggataccacgaaagatctcaatgccgaagttatggagcagtattccgaatcgaaccggcttatcctgatccgcaataccactgacatcttgtattatcttgtacttgataagaatgggaaagtgctgaaacaacgctcattgaatatcattaacgacggggctcgcgacgttgattggaaagagcgttttcggcaggtaacaaaagatcgtaacgaaggctataacgagtgggactactcgcggactagcaacgatttgaaagaggtctatctgaattatgcattgaaggagattgccgaagcggtaatcgaatacaacgcaattttgattattgaaaaaatgtcgaatgccttcaaggataagtactcctttttggatgatgttaccttcaaaggttttgagaccaaacttcttgcgaagctctctgacttgcatttccggggtattaaagatggggagccatgttcgtttacgaacccgttacagttatgtcagaacgactcaaacaaaattttacaagacggtgtgattttcatggtccctaacagcatgacgcgcagtctggaccctgacactgggttcatttttgcgattaacgatcacaacatccgcactaagaaagcgaagttaaacttccttagtaaattcgatcagctgaaagtgtcatcagagggctgtttaatcatgaaatattcgggggactcccttcctacacacaacacagataatcgtgtatggaactgttgttgcaatcacccgatcaccaactacgaccgcgagacgaaaaaggtcgaattcatcgaggagccagtggaagagttgagtcgcgtcttagaagagaatgggattgagacagatacggaacttaacaagcttaacgagcgcgagaatgttccgggcaaggtagtagatgccatctattctctggtgttgaattacttgcgtggtaccgtgtccggcgttgcaggccaacgggcggtctactattcccctgtgacggggaaaaaatatgatatttcgtttatccaagcaatgaatctgaatcgtaagtgcgattactaccggatcgggagcaaagaacgcggcgaatggacggattttgtagcgcagttaattaacgcggccgcaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 83 - DNA, 21 bp, synthetic construct
  misc_feature 1..21: note = Description of Artificial Sequence: Synthetic oligonucleotide
  source 1..21: mol_type = other DNA
ccaccaggggacatggcccag

SEQ ID NO: 84 - DNA, 21 bp, synthetic construct
  misc_feature 1..21: note = Description of Artificial Sequence: Synthetic oligonucleotide
  source 1..21: mol_type = other DNA
aatgtggcaacgtggtgctca

SEQ ID NO: 85 - DNA, 21 bp, synthetic construct
  misc_feature 1..21: note = Description of Artificial Sequence: Synthetic oligonucleotide
  source 1..21: mol_type = other DNA
tgacattagccaaggtcaccc

SEQ ID NO: 86 - DNA, 21 bp, synthetic construct
  misc_feature 1..21: note = Description of Artificial Sequence: Synthetic oligonucleotide
  source 1..21: mol_type = other DNA
cgcaaaggagatgtgtccctg

SEQ ID NO: 87 - DNA, 21 bp, synthetic construct
  misc_feature 1..21: note = Description of Artificial Sequence: Synthetic oligonucleotide
  source 1..21: mol_type = other DNA
tcaggaccttggctggaggca

SEQ ID NO: 88 - DNA, 21 bp, synthetic construct
  misc_feature 1..21: note = Description of Artificial Sequence: Synthetic oligonucleotide
  source 1..21: mol_type = other DNA
ggtcacctggatccctgggga

SEQ ID NO: 89 - DNA, 21 bp, synthetic construct
  misc_feature 1..21: note = Description of Artificial Sequence: Synthetic oligonucleotide
  source 1..21: mol_type = other DNA
ccttccgctcacctccgcctg

SEQ ID NO: 90 - DNA, 21 bp, synthetic construct
  misc_feature 1..21: note = Description of Artificial Sequence: Synthetic oligonucleotide
  source 1..21: mol_type = other DNA
gcacgaagctctccgatgtgt

SEQ ID NO: 91 - DNA, 21 bp, synthetic construct
  misc_feature 1..21: note = Description of Artificial Sequence: Synthetic oligonucleotide
  source 1..21: mol_type = other DNA
ctagcggaatgggcacctcat

SEQ ID NO: 92 - DNA, 21 bp, synthetic construct
  misc_feature 1..21: note = Description of Artificial Sequence: Synthetic oligonucleotide
  source 1..21: mol_type = other DNA
cagtggcgagagaagaccccg

SEQ ID NO: 93 - DNA, 21 bp, synthetic construct
  misc_feature 1..21: note = Description of Artificial Sequence: Synthetic oligonucleotide
  source 1..21: mol_type = other DNA
actgccccccacccaggcctg

SEQ ID NO: 94 - protein, 1368 aa, synthetic construct
  REGION 1..1368: note = Description of Artificial Sequence: Synthetic polypeptide
MGHHHHHHSSGLVPRGSGTMCYDLNNIKTKLREREVETMGNNMDNSFEPFIGGNSVSKTLRNELRVGSEYTGKHIKECAIIAEDAVKAENQYIVKEMMDDFYRDFINRKLDALQGINWEQLFDIMKKAKLDKSNKVSKELDKIQESTRKEIGKIFSSDPIYKDMLKADMISKILPEYIVDKYGDAASRIEAVKVFYGFSGYFIDFWASRKNVFSDKNIASAIPHRIVNVNARIHLDNITAFNRIAEIAGDEVAGIAEDACAYLQNMSLEDVFTGACYGEFICQKDIDRYNNICGVINQHMNQYCQNKKISRSKFKMERLHKQILCRSESGFEIPIGFQTDGEVIDAINSFSTILEEKDILDRLRTLSQEVTGYDMERIYVSSKAFESVSKYIDHKWDVIASSMYNYFSGAVRGKDDKKDVKIQTEIKKIKSCSLLDLKKLVDMYYKMDGMCLEHEATEYVAGITEILVDFNYKTFDMDDSVKMIQNEHMINEIKEYLDTYMSIYHWAKDFMIDELVDRDMEFYSELDEIYYDLSDIVPLYNKVRNYVTQKPYSQDKIKLNFGSPTLANGWSKSKEFDNNVVVLLRDEKIYLAILNVGNKPSKDIMAGEDRRRSDTDYKKMNYYLLPGASKTLPHVFISSNAWKKSHGIPDEIMYGYNQNKHLKSSPNFDLEFCRKLIDYYKECIDSYPNYQIFNFKFAATETYNDISEFYKDVERQGYKIEWSYISEDDINQMDRDGQIYLFQIYNKDFAPNSKGMQNLHTLYLKNIFSEENLSDVVIKLNGEAELFFRKSSIQHKRGHKKGSVLVNKTYKTTEKTENGQGEIEVIESVPDQCYLELVKYWSEGGVGQLSEEASKYKDKVSHYAATMDIVKDRRYTEDKFFIHMPITINFKADNRNNVNEKVLKFIAENDDLHVIGIDRGERNLLYVSVIDSRGRIVEQKSFNIVENYESSKNVIRRHDYRGKLVNKEHYRNEARKSWKEIGKIKEIKEGYLSQVIHEISKLVLKYNAIIVMEDLNYGFKRGRFKVERQVYQKFETMLINKLAYLVDKSRAVDEPGGLLKGYQLTYVPDNLGELGSQCGIIFYVPAAYTSKIDPVTGFVDVFDFKAYSNAEARLDFINKLDCIRYDAPRNKFEIAFDYGNFRTHHTTLAKTSWTIFIHGDRIKKERGSYGWKDEIIDIEARIRKLFEDTDIEYADGHNLIGDINELESPIQKKFVGELFDIIRFTVQLRNSKSEKYDGTEKEYDKIISPVMDEEGVFFTTDSYIRADGTELPKDADANGAYCIALKGLYDVLAVKKYWKEGEKFDRKLLAITNYNWFDFIQNRRFAAAKRPAATKKAGQAKKKKASGSGAGSPKKKRKVEDPKKKRKV

SEQ ID NO: 95 - DNA, 4110 bp, synthetic construct
  misc_feature 1..4110: note = Description of Artificial Sequence: Synthetic polynucleotide
  source 1..4110: mol_type = other DNA
atgggccaccatcatcatcatcatagcagcggcctggtgccgcgcggcagcggtaccatgtgctacgacttaaacaacatcaagacaaagttacgtgaacgcgaagtcgaaactatgggcaataacatggataatagcttcgagccttttattggcggtaatagtgtctctaaaacacttcggaatgagctgcgtgtaggttccgaatatactggtaaacacattaaagagtgcgcgatcattgcagaggacgccgtgaaggcggagaaccagtacatcgtaaaagagatgatggacgacttttaccgtgacttcattaatcgcaaacttgacgccttgcagggtattaattgggagcagctttttgacattatgaagaaggcgaaattggataagtcgaataaagtcagcaaagagttagacaagattcaagagtctacgcggaaagaaatcgggaaaatcttctcatccgatccaatctataaagacatgctcaaagcggacatgatcagcaaaattctgccagagtatattgtcgacaaatacggtgatgcagcctcgcggatcgaagctgtaaaggtgttttacggcttttcgggttattttatcgacttctgggcatcgcgcaagaacgtcttctcagataagaacatcgcgtcggccattccgcaccggattgtcaatgtgaacgctcggatccatctggacaacatcacggccttcaaccgtatcgcagaaattgcaggggatgaagtcgccggcattgctgaagatgcttgtgcttacctgcagaatatgagcttagaggatgtattcacgggggcctgctacggtgagttcatctgtcagaaggatattgatcgttacaataacatttgcggtgttatcaaccagcacatgaatcaatactgccaaaacaaaaagatctcacgctcaaaatttaagatggaacgtctgcacaaacagatcttatgtcgctctgagagtggttttgagatcccgattgggtttcaaaccgacggggaggtaatcgatgctatcaactccttttctacgattcttgaagagaaagatatcttggatcgtctgcgcactttgtcgcaggaggtaacaggttatgacatggagcgtatctatgtaagttccaaggcgtttgagtctgtatcaaagtacatcgatcacaaatgggacgtaattgcttcttccatgtacaattacttttctggggctgttcgtgggaaggacgacaagaaagatgtcaagattcagacggaaattaaaaagattaagtcatgttcgttattggacctcaaaaagctggtagatatgtattataaaatggatgggatgtgtttagagcacgaagcgacggagtacgtggcaggtattacggagatcctggttgactttaactataagaccttcgacatggatgattccgttaagatgattcaaaatgagcacatgattaatgaaattaaagaatatttagatacctatatgtctatctatcattgggcgaaggactttatgatcgatgagctcgtagatcgcgacatggaattctacagtgagctcgatgaaatctattatgatttgtccgacatcgtaccactgtataataaagtccgcaactacgtcacgcaaaaaccgtattcccaggataaaatcaagttaaactttggcagcccaaccttagcaaacggttggagcaagtcgaaagaatttgataacaacgttgtagtattgttgcgtgacgaaaagatttatctggccatcttaaatgtggggaataaaccgtcaaaggatatcatggcgggcgaagaccgtcgtcgctccgatactgattacaagaaaatgaattactatctgctccctggggcaagcaaaaccctgccacacgtttttatctcttcaaatgcatggaagaaatcccacggtatccctgacgagattatgtacggctataaccaaaataagcatttaaaatcttcgccaaacttcgacttagagttttgtcgcaagctgatcgattattacaaagaatgtattgacagctatcctaactatcagatcttcaatttcaaattcgccgctacggaaacttacaacgatatttcggagttctacaaagatgttgaacgtcaggggtacaagattgaatggtcgtacatttccgaggacgatattaatcagatggatcgtgacggccagatttatctttttcaaatctacaacaaggattttgccccaaactctaagggcatgcagaatttacatacactctatttaaaaaatattttttcagaggaaaacctctctgatgtcgtcattaaactgaatggcgaggctgagctcttcttccgcaagagctcgatccaacataaacgcggtcataagaagggtagtgtgttggtaaataagacctataaaaccacagaaaaaactgaaaatggtcaaggcgaaattgaagtaatcgagagcgtgccggaccagtgttacctggagcttgttaagtactggtcagagggtggtgtaggtcagttgtcagaagaggcttccaaatacaaagataaagtcagccactacgctgcaacaatggatattgtcaaggaccggcggtacacggaggataagttctttattcacatgccgattacgattaattttaaagctgataaccggaacaatgtcaacgagaaagtgctgaagtttattgcagaaaacgatgatctccacgttattggtattgaccgtggggaacgtaatctcctgtacgtctcagtaattgattcacgtgggcgtattgttgagcagaagtcgtttaatattgttgagaattacgagagcagtaaaaatgtgatccgccgccatgattatcgtgggaaattagtaaataaagagcactatcgtaatgaggcacgtaagagctggaaagaaatcggcaaaatcaaggagatcaaagaaggttatctcagtcaagttatccatgagattagtaagttggtattaaagtataacgccatcatcgtgatggaagatcttaattatggcttcaaacgcgggcggtttaaagtcgagcggcaggtataccagaagttcgagaccatgcttattaacaaattagcctacttagtggacaaatcacgcgcggtagacgaaccgggtgggttattaaaaggctaccagctgacatacgtgccagataacttgggtgaactggggtcccagtgcgggatcattttttatgtgccagcagcatacacttcgaaaatcgatcctgttacgggctttgtagacgtgtttgattttaaggcatactccaatgccgaagcacgtttagatttcatcaataaactggactgcatccggtatgacgcgccgcgtaacaagtttgaaattgctttcgactacggtaacttccggactcatcatacaacccttgcaaagactagctggactatttttattcacggcgaccgtattaaaaaggagcgcggttcttacggctggaaggacgaaattatcgatatcgaggcccgtattcgtaagctgtttgaagacacagacatcgaatacgccgatggtcacaatttgatcggtgacattaacgagctcgagagtccaattcaaaagaaattcgttggtgagctgttcgacattatccgtttcactgtccaactgcgcaacagcaaaagtgagaaatatgacggcaccgaaaaggagtatgacaaaattatttcgccggtaatggacgaggagggggttttctttacaaccgacagttatatccgcgcagatggtactgaattacctaaagatgctgatgctaacggggcctattgtatcgcgctgaagggtctttacgacgtgctcgcggtaaagaaatattggaaggagggggagaagttcgatcggaagttacttgccatcaccaattacaactggtttgatttcattcagaatcgtcgcttcgcggccgcaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 96 - DNA, 21 bp, synthetic construct
  misc_feature 1..21: note = Description of Artificial Sequence: Synthetic oligonucleotide
  source 1..21: mol_type = other DNA
accgagacctcagtgggctgg

SEQ ID NO: 97 - DNA, 21 bp, synthetic construct
  misc_feature 1..21: note = Description of Artificial Sequence: Synthetic oligonucleotide
  source 1..21: mol_type = other DNA
tgggccctactctgtgaccaa

SEQ ID NO: 98 - DNA, 21 bp, synthetic construct
  misc_feature 1..21: note = Description of Artificial Sequence: Synthetic oligonucleotide
  source 1..21: mol_type = other DNA
tgtgctcagtgaccagcccaa

SEQ ID NO: 99 - DNA, 21 bp, synthetic construct
  misc_feature 1..21: note = Description of Artificial Sequence: Synthetic oligonucleotide
  source 1..21: mol_type = other DNA
cccacccacatctcagagttt

SEQ ID NO: 100 - DNA, 21 bp, synthetic construct
  misc_feature 1..21: note = Description of Artificial Sequence: Synthetic oligonucleotide
  source 1..21: mol_type = other DNA
ttgtgcgtgagagcctcagcc

SEQ ID NO: 101 - DNA, 21 bp, synthetic construct
  misc_feature 1..21: note = Description of Artificial Sequence: Synthetic oligonucleotide
  source 1..21: mol_type = other DNA
aagaagacggggattgaggag

SEQ ID NO: 102 - RNA, 11 nt, synthetic construct
  misc_feature 1..11: note = Description of Artificial Sequence: Synthetic oligonucleotide
  source 1..11: mol_type = other RNA
ggaatttctac

SEQ ID NO: 103 - DNA, 21 bp, synthetic construct
  misc_feature 1..21: note = Description of Artificial Sequence: Synthetic oligonucleotide
  source 1..21: mol_type = other DNA
gctccccccagggtggacgct

SEQ ID NO: 104 - DNA, 21 bp, synthetic construct
  misc_feature 1..21: note = Description of Artificial Sequence: Synthetic oligonucleotide
  source 1..21: mol_type = other DNA
ggctggtcactgagcacagaa

SEQ ID NO: 105 - DNA, 21 bp, synthetic construct
  misc_feature 1..21: note = Description of Artificial Sequence: Synthetic oligonucleotide
  source 1..21: mol_type = other DNA
gtcctccctctagtggctgag

SEQ ID NO: 106 - DNA, 21 bp, synthetic construct
  misc_feature 1..21: note = Description of Artificial Sequence: Synthetic oligonucleotide
  source 1..21: mol_type = other DNA
gcagacagggagaaataagga

SEQ ID NO: 107 - protein, 1525 aa, synthetic construct
  REGION 1..1525: note = Description of Artificial Sequence: Synthetic polypeptide
MGHHHHHHSSGLVPRGSGTMSDRLDVLTNQYPLSKTLRFELKPVGATADWIRKHNVIRYHNGKLVGKDAIRFQNYKYLKKMLDEMHRLFLQQALVLEPNSNQAQELTALLRAIENNYCNNNDLLAGDYPSLSTDKTIKISNGLSKLTTDLFDKKFEDWAYQYKEDMPNFWRQDIAELEQKLQVSANAKDQKFYKGIIKKLKNKIQKSELKAETHKGLYSPTESLQLLEWLVRRGDIKLTYLEIGKENEKLNELVPLVELKDIHRNFNNFATYLSGFSKNRENVYSTKFDRRSGYKATSVIARTFEQNLMFCLGNIAKWHKVTEFINQANNYELLQEHGIDWNKQIAALEHKLDVCLAEFFALNNFSQTLAQQGIEKYNQVLAGIAEIAGQPKTQGLNELINLARQKLSAKRSQLPTLQLLYKQILSKGDKPFIDDFKSDQELIAELNEFVSSQIHGEHGAIKLINHELESFINEARAAQQQIYVPKDKLTELSLLLTGSWQAINQWRYKLFDQKQLDKQQKQYSFSLAQVERWLATEVEQQNFYQTEKERQQHKDTQPANVTTSSDGHSILTAFEQQVQTLLTNICVAAEKYRQLSDNLTAIDKQRESESSKGFEQIAVIKTLLDACNELNHFLARFTVNKKDKLPEDRAEFWYEKLQAYIDAFPIYELYNKVRNYLSKKPFSTEKVKINFDNSHFLSGWTADYERHSALLFKFNENYLLGVVNENLSSEEEEKLKLVGGEEHAKRFIYDFQKIDNSNPPRVFIRSKGSSFAPAVEKYQLPIGDIIDIYDQGKFKTEHKKKNEAEFKDSLVRLIDYFKLGFSRHDSYKHYPFKWKASHQYSDIAEFYAHTASFCYTLKEENINFNVLRELSSAGKVYLFEIYNKDFSKNKRGQGRDNLHTSYWKLLFSAENLKDVVLKLNGQAEIFYRPASLAETKAYTHKKGEVLKHKAYSKVWEALDSPIGTRLSWDDALKIPSITEKTNHNNQRVVQYNGQEIGRKAEFAIIKNRRYSVDKFLFHCPITLNFKANGQDNINARVNQFLANNKKINIIGIDRGEKHLLYISVINQQGEVLHQESFNTITNSYQTANGEKRQVVTDYHQKLDMSEDKRDKARKSWSTIENIKELKAGYLSHVVHRLAQLIIEFNAIVALEDLNHGFKRGRFKIEKQVYQKFEKALIDKLSYLAFKDRTSCLETGHYLNAFQLTSKFKGFNNLGKQSGILFYVNADYTSTTDPLTGYIKNVYKTYSSVKDSTEFWQRFNSIRYIASENRFEFSYDLADLKQKSLESKTKQTPLAKTQWTVSSHVTRSYYNQQTKQHELFEVTARIQQLLSKAEISYQHQNDLIPALASCQSKALHKELIWLFNSILTMRVTDSSKPSATSENDFILSPVAPYFDSRNLNKQLPENGDANGAYNIARKGIMLLERIGDFVPEGNKKYPDLLIRNNDWQNFVQRPEMVNKQKKKLVKLKTEYSNGSLFNDLAFKAAAKRPAATKKAGQAKKKKASGSGAGSPKKKRKVEDPKKKRKV

SEQ ID NO: 108 - DNA, 4581 bp, synthetic construct
  misc_feature 1..4581: note = Description of Artificial Sequence: Synthetic polynucleotide
  source 1..4581: mol_type = other DNA
atggggcatcaccaccaccaccactcgtcgggtcttgttccacgtggttctggtaccatgtctgatcgcctggacgtgcttactaaccaatacccattatcgaaaactttgcgcttcgaattgaagccggttggagccacagctgactggattcgcaaacacaacgttatccgctatcataatggtaaactggttggaaaggatgcgatccgttttcaaaattataagtatctgaagaaaatgcttgatgagatgcatcgcttatttcttcagcaagcactggtgttggagccaaatagcaaccaggcgcaggagttgaccgcactgctgcgtgctattgagaataattattgcaacaacaacgacctgctggcgggcgattatcccagcctctctaccgataagaccattaaaatcagcaacggccttagcaagctgaccacggatctgttcgataagaagttcgaagactgggcataccaatacaaagaagatatgcccaatttctggcgtcaagatattgcggaattagagcaaaagcttcaggtgagtgcgaacgcaaaagatcaaaagttctacaaagggatcatcaagaagctgaagaataagatccagaagtctgaactgaaagcggaaacgcacaagggcttatactcacctacggagtcactgcaactgctggagtggctggtacgtcgtggcgatattaaactgacttacttagagattggtaaagagaacgagaaacttaatgaactggtcccgctggtcgaacttaaggacattcatcgcaatttcaataatttcgccacatatctttctggcttcagcaagaatcgtgagaatgtgtactcaaccaaatttgatcgtcgttcgggttataaagccaccagtgtaatcgcacgcacgttcgaacagaatttaatgttctgtcttggtaacattgccaagtggcacaaggtgacagaattcatcaaccaggcgaacaattacgagctcctgcaggagcacggcatcgattggaataagcaaattgccgcgctggaacacaaactggacgtgtgtctcgcagagttcttcgcgcttaataacttctcacaaacccttgcacaacagggtatcgaaaagtataaccaggtcttggccggcatcgccgagattgcaggccaacccaagacccagggcctgaacgaactcattaacctggcccgtcagaaattgtctgccaaacgctcacaactgcctacgttgcaactcctttacaaacaaatcttaagcaagggtgataagccattcatcgacgattttaaaagcgaccaagagttgatcgccgaattaaatgagtttgtaagcagccagattcacggagagcatggtgcaatcaaattaattaatcacgaacttgaaagctttatcaatgaagcccgtgcagcgcagcaacagatttatgtgcccaaggacaagcttaccgaattaagtcttctcttaacgggcagttggcaagctattaatcaatggcgttacaaactgttcgaccagaaacagctggataaacaacagaaacaatattcatttagcctggcccaggttgaacgctggctggcaactgaggttgagcaacaaaacttctaccaaaccgaaaaggagcgccagcagcataaagatacgcagccggcgaacgtcaccaccagcagcgatggacacagcattttaacagcatttgagcaacaggtgcagaccttattaaccaacatctgtgttgctgccgagaaatatcgccaattaagtgataatctcacagccatcgataaacaacgcgagagcgaatcaagtaagggattcgagcaaatcgcggtgattaaaaccttgctggacgcgtgtaacgagctgaatcactttctggcacgcttcacggtcaacaagaaggacaaactccccgaagatcgcgcagaattttggtatgaaaagttacaagcgtacattgacgcgtttccgatctacgagctgtataataaagtgcgtaattacttaagcaagaagccgtttagcactgagaaagtcaaaattaattttgacaattcccatttcctgtcgggttggacggcggactatgagcgtcacagcgccttattattcaaatttaatgaaaattacctgctgggtgtagtgaatgagaacttaagcagcgaggaagaagaaaagctgaagctcgtgggcggcgaagaacatgccaagcgcttcatttatgattttcagaaaatcgacaactcaaacccaccgcgcgttttcattcgtagcaaggggtcatcgttcgcacctgcggtcgaaaagtatcagttaccgattggcgatatcattgacatttacgatcagggtaaatttaagacagaacacaagaagaagaatgaggccgagtttaaagacagtctggtacgtttgatcgattattttaagctgggcttctctcgccatgacagctataagcactacccattcaagtggaaagccagtcatcaatatagcgacattgcggaattttacgctcataccgcctcattttgttacacgcttaaggaagaaaacatcaattttaacgttctgcgtgagttgtcgtcggcgggcaaagtatatctcttcgaaatttacaataaggatttctcaaagaacaagcgcggccaaggacgcgacaacttgcataccagttattggaagttgctgttctcggctgagaacctgaaggatgttgtgctgaaattaaacggccaagcggagatcttttaccgcccagcgtctttggccgaaaccaaggcctacacccataagaaaggggaagtactgaaacataaggcttatagcaaagtgtgggaagccctggattctcccattggcacccgcctgagctgggacgatgctttaaagatcccgtctattaccgagaagaccaatcacaataatcagcgtgttgtccagtacaacggccaagaaattggccgcaaagcggagttcgctattatcaagaaccgccgttattccgtcgataaattcctctttcactgcccgattacactcaacttcaaggcgaacggccaggacaacattaacgcacgcgttaatcaattcctggcaaataacaagaagatcaacattattggaattgaccgtggtgaaaagcatttactgtatatcagcgtgattaatcaacaaggcgaagtcctgcatcaggaaagcttcaatacaatcacgaattcatatcagaccgccaatggcgagaaacgccaagtagtcactgactatcaccagaagttggacatgagcgaggacaaacgcgataaagcacgtaagagctggagtacaatcgaaaatatcaaagagctgaaggcggggtatctgagccacgttgtacatcgcctcgcgcaactgattatcgaatttaatgccattgttgcgttggaagatcttaaccacgggttcaaacgcggacgttttaaaatcgaaaagcaagtgtatcagaagttcgaaaaggcgctgatcgacaaattgagctacttagcgtttaaggatcgcacgtcgtgtctggaaactggacattacttgaatgcctttcaattaacctcaaagttcaaaggctttaacaaccttggcaagcaatccgggattttgttctacgttaacgccgattacacgagcaccacggatcccttaacaggctatattaagaacgtatacaaaacctactcctcggtgaaggattcgaccgaattttggcagcgctttaactctatccgctatattgcgagcgagaaccgttttgaatttagctacgacttagcggacctgaaacagaagtcgctcgagagtaaaaccaaacagacccctctcgccaagacccaatggacggtctctagccacgttacccgttcctattacaaccagcagacgaagcaacatgagttattcgaagtgacagcgcgcattcagcaattgcttagcaaagcagaaatcagctatcaacatcaaaacgacttgatccctgcgttagcatcatgtcaaagtaaggcgttacacaaggagttgatttggctgttcaacagcatcctgactatgcgcgtcacggactcaagcaaaccgtccgcgacctcggagaatgattttatcctgagcccggtagcgccgtacttcgactcccgcaatctgaataagcagctgccggaaaacggcgacgcgaacggcgcatacaatatcgctcgtaaaggtatcatgcttctggaacgtatcggggacttcgtcccggaaggtaacaagaagtaccccgatttactgatccgcaataatgactggcagaattttgtacaacgcccggagatggtgaacaagcagaagaagaaactcgtgaagttgaaaacggaatactctaatggcagcctcttcaatgatttggcgtttaaggccgcagctaagcgccccgccgcgactaagaaagcgggtcaagcgaagaagaagaaagcgtcggggtcgggagcgggcagtccgaagaagaagcgtaaagtagaggatccgaagaagaaacgcaaagtataataa

SEQ ID NO: 109 - DNA, 21 bp, synthetic construct
  misc_feature 1..21: note = Description of Artificial Sequence: Synthetic oligonucleotide
  source 1..21: mol_type = other DNA
ccagctcactaagtcagtctc

SEQ ID NO: 110 - DNA, 21 bp, synthetic construct
  misc_feature 1..21: note = Description of Artificial Sequence: Synthetic oligonucleotide
  source 1..21: mol_type = other DNA
tatggagaagctctcatttct

SEQ ID NO: 111 - DNA, 21 bp, synthetic construct
  misc_feature 1..21: note = Description of Artificial Sequence: Synthetic oligonucleotide
  source 1..21: mol_type = other DNA
taagatgctatttcccgtata

SEQ ID NO: 112 - DNA, 21 bp, synthetic construct
  misc_feature 1..21: note = Description of Artificial Sequence: Synthetic oligonucleotide
  source 1..21: mol_type = other DNA
ccgtgtcattctctggactgc

SEQ ID NO: 113 - DNA, 21 bp, synthetic construct
  misc_feature 1..21: note = Description of Artificial Sequence: Synthetic oligonucleotide
  source 1..21: mol_type = other DNA
attcctccacttcaacacctg

SEQ ID NO: 114 - DNA, 21 bp, synthetic construct
  misc_feature 1..21: note = Description of Artificial Sequence: Synthetic oligonucleotide
  source 1..21: mol_type = other DNA
tacgggaaatagcatcttaga

SEQ ID NO: 115 - DNA, 21 bp, synthetic construct
  misc_feature 1..21: note = Description of Artificial Sequence: Synthetic oligonucleotide
  source 1..21: mol_type = other DNA
gtggcaatggataaggccgag

SEQ ID NO: 116 - DNA, 21 bp, synthetic construct
  misc_feature 1..21: note = Description of Artificial Sequence: Synthetic oligonucleotide
  source 1..21: mol_type = other DNA
cttgcttcaggaatggccagg

SEQ ID NO: 117 - DNA, 21 bp, synthetic construct
  misc_feature 1..21: note = Description of Artificial Sequence: Synthetic oligonucleotide
  source 1..21: mol_type = other DNA
tagttcaaaacctctatcaat

SEQ ID NO: 118 - DNA, 21 bp, synthetic construct
  misc_feature 1..21: note = Description of Artificial Sequence: Synthetic oligonucleotide
  source 1..21: mol_type = other DNA
tctgtgatatacacatcagaa

SEQ ID NO: 119 - DNA, 21 bp, synthetic construct
  misc_feature 1..21: note = Description of Artificial Sequence: Synthetic oligonucleotide
  source 1..21: mol_type = other DNA
ggcagacagggagaaataagg

SEQ ID NO: 120 - DNA, 21 bp, synthetic construct
  misc_feature 1..21: note = Description of Artificial Sequence: Synthetic oligonucleotide
  source 1..21: mol_type = other DNA
ctcgatataaggccttgagca

SEQ ID NO: 121 - DNA, 21 bp, synthetic construct
  misc_feature 1..21: note = Description of Artificial Sequence: Synthetic oligonucleotide
  source 1..21: mol_type = other DNA
gagtctctcagctggtacacg

SEQ ID NO: 122 - DNA, 21 bp, synthetic construct
  misc_feature 1..21: note = Description of Artificial Sequence: Synthetic oligonucleotide
  source 1..21: mol_type = other DNA
tggcagacagggagaaataag

SEQ ID NO: 123 - DNA, 21 bp, synthetic construct
  misc_feature 1..21: note = Description of Artificial Sequence: Synthetic oligonucleotide
  source 1..21: mol_type = other DNA
ccagctgacagatgggctccc

SEQ ID NO: 124 - DNA, 21 bp, synthetic construct
  misc_feature 1..21: note = Description of Artificial Sequence: Synthetic oligonucleotide
  source 1..21: mol_type = other DNA
ccgtataaagcatgagaccgt

SEQ ID NO: 125 - DNA, 21 bp, synthetic construct
  misc_feature 1..21: note = Description of Artificial Sequence: Synthetic oligonucleotide
  source 1..21: mol_type = other DNA
ccccaacccaggctggagtcc

SEQ ID NO: 126 - DNA, 21 bp, synthetic construct
  misc_feature 1..21: note = Description of Artificial Sequence: Synthetic oligonucleotide
  source 1..21: mol_type = other DNA
ttggcagacagggagaaataa

SEQ ID NO: 127 - DNA, 21 bp, synthetic construct
  misc_feature 1..21: note = Description of Artificial Sequence: Synthetic oligonucleotide
  source 1..21: mol_type = other DNA
tcagaagagcctggctaggaa

SEQ ID NO: 128 - DNA, 21 bp, synthetic construct
  misc_feature 1..21: note = Description of Artificial Sequence: Synthetic oligonucleotide
  source 1..21: mol_type = other DNA
ctctgccagagttatattgct

SEQ ID NO: 129 - DNA, 21 bp, synthetic construct
  misc_feature 1..21: note = Description of Artificial Sequence: Synthetic oligonucleotide
  source 1..21: mol_type = other DNA
ccatgcctgcctttactctgc

SEQ ID NO: 130 - DNA, 21 bp, synthetic construct
  misc_feature 1..21: note = Description of Artificial Sequence: Synthetic oligonucleotide
  source 1..21: mol_type = other DNA
gtctgtgatatacacatcaga

SEQ ID NO: 131 - DNA, 21 bp, synthetic construct
  misc_feature 1..21: note = Description of Artificial Sequence: Synthetic oligonucleotide
  source 1..21: mol_type = other DNA
cggatcttcctggcggcgcga

SEQ ID NO: 132 - DNA, 21 bp, synthetic construct
  misc_feature 1..21: note = Description of Artificial Sequence: Synthetic oligonucleotide
  source 1..21: mol_type = other DNA
aaggcagctggcaccagtgcc

SEQ ID NO: 133 - DNA, 21 bp, synthetic construct
  misc_feature 1..21: note = Description of Artificial Sequence: Synthetic oligonucleotide
  source 1..21: mol_type = other DNA
tggtgtcactggcggcggccg

SEQ ID NO: 134 - DNA, 21 bp, synthetic construct
  misc_feature 1..21: note = Description of Artificial Sequence: Synthetic oligonucleotide
  source 1..21: mol_type = other DNA
ttctgccccgactgcagccac

SEQ ID NO: 135 - DNA, 21 bp, synthetic construct
  misc_feature 1..21: note = Description of Artificial Sequence: Synthetic oligonucleotide
  source 1..21: mol_type = other DNA
gtgaccggcacgagggctaag

SEQ ID NO: 136 - DNA, 21 bp, synthetic construct
  misc_feature 1..21: note = Description of Artificial Sequence: Synthetic oligonucleotide
  source 1..21: mol_type = other DNA
ccatcggcctgactcccatgc

SEQ ID NO: 137 - DNA, 21 bp, synthetic construct
  misc_feature 1..21: note = Description of Artificial Sequence: Synthetic oligonucleotide
  source 1..21: mol_type = other DNA
ccatcaccatcagcaccgggt

SEQ ID NO: 138 - DNA, 21 bp, synthetic construct
  misc_feature 1..21: note = Description of Artificial Sequence: Synthetic oligonucleotide
  source 1..21: mol_type = other DNA
tcacagcccaagatagttaag

SEQ ID NO: 139 - DNA, 21 bp, synthetic construct
  misc_feature 1..21: note = Description of Artificial Sequence: Synthetic oligonucleotide
  source 1..21: mol_type = other DNA
ctgaattgctatgtgtctggg

SEQ ID NO: 140 - DNA, 21 bp, synthetic construct
  misc_feature 1..21: note = Description of Artificial Sequence: Synthetic oligonucleotide
  source 1..21: mol_type = other DNA
ctgaagaatggagagagaatt

SEQ ID NO: 141 - DNA, 21 bp, synthetic construct
  misc_feature 1..21: note = Description of Artificial Sequence: Synthetic oligonucleotide
  source 1..21: mol_type = other DNA
tcagtgggggtgaattcagtg

SEQ ID NO: 142 - DNA, 21 bp, synthetic construct
  misc_feature 1..21: note = Description of Artificial Sequence: Synthetic oligonucleotide
  source 1..21: mol_type = other DNA
cattctctgctggatgacgtg

SEQ ID NO: 143 - DNA, 21 bp, synthetic construct
  misc_feature 1..21: note = Description of Artificial Sequence: Synthetic oligonucleotide
  source 1..21: mol_type = other DNA
atccatccgacattgaagttg

SEQ ID NO: 144 - DNA, 21 bp, synthetic construct
  misc_feature 1..21: note = Description of Artificial Sequence: Synthetic oligonucleotide
  source 1..21: mol_type = other DNA
ccccacttaactatcttgggc

SEQ ID NO: 145 - DNA, 21 bp, synthetic construct
  misc_feature 1..21: note = Description of Artificial Sequence: Synthetic oligonucleotide
  source 1..21: mol_type = other DNA
gctgtgctcgcgctactctct

SEQ ID NO: 146 - DNA, 21 bp, synthetic construct
  misc_feature 1..21: note = Description of Artificial Sequence: Synthetic oligonucleotide
  source 1..21: mol_type = other DNA
gctggtgtcgttttgtcctga

SEQ ID NO: 147 - DNA, 21 bp, synthetic construct
  misc_feature 1..21: note = Description of Artificial Sequence: Synthetic oligonucleotide
  source 1..21: mol_type = other DNA
tgctggcatctccatactctc

SEQ ID NO: 148 - DNA, 21 bp, synthetic construct
  misc_feature 1..21: note = Description of Artificial Sequence: Synthetic oligonucleotide
  source 1..21: mol_type = other DNA
gtctcttgcagtgcctttctc

SEQ ID NO: 149 - DNA, 21 bp, synthetic construct
  misc_feature 1..21: note = Description of Artificial Sequence: Synthetic oligonucleotide
  source 1..21: mol_type = other DNA
ctgttgcagatccagaaccgt

SEQ ID NO: 150 - DNA, 21 bp, synthetic construct
  misc_feature 1..21: note = Description of Artificial Sequence: Synthetic oligonucleotide
  source 1..21: mol_type = other DNA
acagctaaagaaaagaagccc

SEQ ID NO: 151 - DNA, 21 bp, synthetic construct
  misc_feature 1..21: note = Description of Artificial Sequence: Synthetic oligonucleotide
  source 1..21: mol_type = other DNA
tcaattgatgggaataaaata

SEQ ID NO: 152 - DNA, 21 bp, synthetic construct
  misc_feature 1..21: note = Description of Artificial Sequence: Synthetic oligonucleotide
  source 1..21: mol_type = other DNA
ctcctctggatccttgcagca

SEQ ID NO: 153 - DNA, 21 bp, synthetic construct
  misc_feature 1..21: note = Description of Artificial Sequence: Synthetic oligonucleotide
  source 1..21: mol_type = other DNA
cacatagacccctgttgtaag

SEQ ID NO: 154 - DNA, 21 bp, synthetic construct
  misc_feature 1..21: note = Description of Artificial Sequence: Synthetic oligonucleotide
  source 1..21: mol_type = other DNA
ctagatgattccatctgcacg

SEQ ID NO: 155 - DNA, 21 bp, synthetic construct
  misc_feature 1..21: note = Description of Artificial Sequence: Synthetic oligonucleotide
  source 1..21: mol_type = other DNA
ttcttctcttcatccctgtct

SEQ ID NO: 156 - DNA, 21 bp, synthetic construct
  misc_feature 1..21: note = Description of Artificial Sequence: Synthetic oligonucleotide
  source 1..21: mol_type = other DNA
aggatattcacaaatgttgac

SEQ ID NO: 157 - DNA, 21 bp, synthetic construct
  misc_feature 1..21: note = Description of Artificial Sequence: Synthetic oligonucleotide
  source 1..21: mol_type = other DNA
gaaggtaaaagaccatcgttc

SEQ ID NO: 158 - DNA, 21 bp, synthetic construct
  misc_feature 1..21: note = Description of Artificial Sequence: Synthetic oligonucleotide
  source 1..21: mol_type = other DNA
tcatacatcatctgaagaaca

SEQ ID NO: 159 - DNA, 21 bp, synthetic construct
  misc_feature 1..21: note = Description of Artificial Sequence: Synthetic oligonucleotide
  source 1..21: mol_type = other DNA
atctttcctcacaacagctgc

SEQ ID NO: 160 - DNA, 21 bp, synthetic construct
  misc_feature 1..21: note = Description of Artificial Sequence: Synthetic oligonucleotide
  source 1..21: mol_type = other DNA
agtgaagagaaaggaagtaca

SEQ ID NO: 161 - DNA, 21 bp, synthetic construct
  misc_feature 1..21: note = Description of Artificial Sequence: Synthetic oligonucleotide
  source 1..21: mol_type = other DNA
tttgttctttcagtgaagaga

SEQ ID NO: 162 - DNA, 21 bp, synthetic construct
  misc_feature 1..21: note = Description of Artificial Sequence: Synthetic oligonucleotide
  source 1..21: mol_type = other DNA
ctaggcttagaagtggaaata

SEQ ID NO: 163 - DNA, 21 bp, synthetic construct
  misc_feature 1..21: note = Description of Artificial Sequence: Synthetic oligonucleotide
  source 1..21: mol_type = other DNA
gaaggcctgcatcatgatggc

SEQ ID NO: 164 - DNA, 21 bp, synthetic construct
  misc_feature 1..21: note = Description of Artificial Sequence: Synthetic oligonucleotide
  source 1..21: mol_type = other DNA
gtgcaagggtcacagtgttca

SEQ ID NO: 165 - DNA, 21 bp, synthetic construct
  misc_feature 1..21: note = Description of Artificial Sequence: Synthetic oligonucleotide
  source 1..21: mol_type = other DNA
ggacgataatctagcaacaga

SEQ ID NO: 166 - DNA, 21 bp, synthetic construct
  misc_feature 1..21: note = Description of Artificial Sequence: Synthetic oligonucleotide
  source 1..21: mol_type = other DNA
ttccttgggcaggtgaaagga

SEQ ID NO: 167 - DNA, 21 bp, synthetic construct
  misc_feature 1..21: note = Description of Artificial Sequence: Synthetic oligonucleotide
  source 1..21: mol_type = other DNA
gtttacatctgcacttggtat

SEQ ID NO: 168 - DNA, 21 bp, synthetic construct
  misc_feature 1..21: note = Description of Artificial Sequence: Synthetic oligonucleotide
  source 1..21: mol_type = other DNA
cttggtgcaagggtcacagtg

SEQ ID NO: 169 - DNA, 21 bp, synthetic construct
  misc_feature 1..21: note = Description of Artificial Sequence: Synthetic oligonucleotide
  source 1..21: mol_type = other DNA
ctgttctgctgtgtcttggac

SEQ ID NO: 170 - DNA, 21 bp, synthetic construct
  misc_feature 1..21: note = Description of Artificial Sequence: Synthetic oligonucleotide
  source 1..21: mol_type = other DNA
ctctttgcacttggtgttgct

SEQ ID NO: 171 - DNA, 21 bp, synthetic construct
  misc_feature 1..21: note = Description of Artificial Sequence: Synthetic oligonucleotide
  source 1..21: mol_type = other DNA
tgttctgctgtgtcttggaca

SEQ ID NO: 172 - DNA, 21 bp, synthetic construct
  misc_feature 1..21: note = Description of Artificial Sequence: Synthetic oligonucleotide
  source 1..21: mol_type = other DNA
acaggttcttacgtctgttgc

SEQ ID NO: 173 - DNA, 21 bp, synthetic construct
  misc_feature 1..21: note = Description of Artificial Sequence: Synthetic oligonucleotide
  source 1..21: mol_type = other DNA
ggcaggtgaaaggaaagctag

SEQ ID NO: 174 - DNA, 21 bp, synthetic construct
  misc_feature 1..21: note = Description of Artificial Sequence: Synthetic oligonucleotide
  source 1..21: mol_type = other DNA
ctagggtattctcatagcaaa

SEQ ID NO: 175 - DNA, 21 bp, synthetic construct
  misc_feature 1..21: note = Description of Artificial Sequence: Synthetic oligonucleotide
  source 1..21: mol_type = other DNA
ccccagcagacgggcacgagg

SEQ ID NO: 176 - DNA, 21 bp, synthetic construct
  misc_feature 1..21: note = Description of Artificial Sequence: Synthetic oligonucleotide
  source 1..21: mol_type = other DNA
gccaacctccctccctcagga

SEQ ID NO: 177 - DNA, 21 bp, synthetic construct
  misc_feature 1..21: note = Description of Artificial Sequence: Synthetic oligonucleotide
  source 1..21: mol_type = other DNA
tgtttccatagcaaatatcca

SEQ ID NO: 178 - DNA, 21 bp, synthetic construct
  misc_feature 1..21: note = Description of Artificial Sequence: Synthetic oligonucleotide
  source 1..21: mol_type = other DNA
gatccggcagcagtagatccc

SEQ ID NO: 179 - DNA, 21 bp, synthetic construct
  misc_feature 1..21: note = Description of Artificial Sequence: Synthetic oligonucleotide
  source 1..21: mol_type = other DNA
ccaatcctgagggagggaggt

SEQ ID NO: 180 - DNA, 21 bp, synthetic construct
  misc_feature 1..21: note = Description of Artificial Sequence: Synthetic oligonucleotide
  source 1..21: mol_type = other DNA
cgggactctggagcaaccatc

SEQ ID NO: 181 - DNA, 21 bp, synthetic construct
  misc_feature 1..21: note = Description of Artificial Sequence: Synthetic oligonucleotide
  source 1..21: mol_type = other DNA
gccagtatctggatgtccaat

SEQ ID NO: 182 - DNA, 21 bp, synthetic construct
  misc_feature 1..21: note = Description of Artificial Sequence: Synthetic oligonucleotide
  source 1..21: mol_type = other DNA
actgcagcctttccaaggatg

SEQ ID NO: 183 - DNA, 21 bp, synthetic construct
  misc_feature 1..21: note = Description of Artificial Sequence: Synthetic oligonucleotide
  source 1..21: mol_type = other DNA
ccccttactagggtattctca

SEQ ID NO: 184 - DNA, 21 bp, synthetic construct
  misc_feature 1..21: note = Description of Artificial Sequence: Synthetic oligonucleotide
  source 1..21: mol_type = other DNA
acctgaagttggtcatcaaac

SEQ ID NO: 185 - DNA, 21 bp, synthetic construct
  misc_feature 1..21: note = Description of Artificial Sequence: Synthetic oligonucleotide
  source 1..21: mol_type = other DNA
ccaaggatgcttaccaccagg

SEQ ID NO: 186 - DNA, 21 bp, synthetic construct
  misc_feature 1..21: note = Description of Artificial Sequence: Synthetic oligonucleotide
  source 1..21: mol_type = other DNA
gtttcccccttactagggtat

SEQ ID NO: 187 - DNA, 21 bp, synthetic construct
  misc_feature 1..21: note = Description of Artificial Sequence: Synthetic oligonucleotide
  source 1..21: mol_type = other DNA
atcagtcctgagcaccacgtt

SEQ ID NO: 188 - DNA, 21 bp, synthetic construct
  misc_feature 1..21: note = Description of Artificial Sequence: Synthetic oligonucleotide
  source 1..21: mol_type = other DNA
tgaggtgactccagtatctgg

SEQ ID NO: 189 - DNA, 21 bp, synthetic construct
  misc_feature 1..21: note = Description of Artificial Sequence: Synthetic oligonucleotide
  source 1..21: mol_type = other DNA
ccagccttggcaatgccagct

SEQ ID NO: 190 - DNA, 21 bp, synthetic construct
  misc_feature 1..21: note = Description of Artificial Sequence: Synthetic oligonucleotide
  source 1..21: mol_type = other DNA
tgtggagctctctggacaccc

SEQ ID NO: 191 - DNA, 21 bp, synthetic construct
  misc_feature 1..21: note = Description of Artificial Sequence: Synthetic oligonucleotide
  source 1..21: mol_type = other DNA
gggcaggaagaggaagctttc

SEQ ID NO: 192 - DNA, 21 bp, synthetic construct
  misc_feature 1..21: note = Description of Artificial Sequence: Synthetic oligonucleotide
  source 1..21: mol_type = other DNA
tccataggtgcccaacgctct

SEQ ID NO: 193 - DNA, 21 bp, synthetic construct
  misc_feature 1..21: note = Description of Artificial Sequence: Synthetic oligonucleotide
  source 1..21: mol_type = other DNA
ccacctgaggctgacctgtga

SEQ ID NO: 194 - DNA, 21 bp, synthetic construct
  misc_feature 1..21: note = Description of Artificial Sequence: Synthetic oligonucleotide
  source 1..21: mol_type = other DNA
cccagggatccaggtgaccca

SEQ ID NO: 195 - DNA, 21 bp, synthetic construct
  misc_feature 1..21: note = Description of Artificial Sequence: Synthetic oligonucleotide
  source 1..21: mol_type = other DNA
acctggagccacccaaagcgg

SEQ ID NO: 196 - DNA, 21 bp, synthetic construct
  misc_feature 1..21: note = Description of Artificial Sequence: Synthetic oligonucleotide
  source 1..21: mol_type = other DNA
cccttcgactagaggatgtga

SEQ ID NO: 197 - DNA, 21 bp, synthetic construct
  misc_feature 1..21: note = Description of Artificial Sequence: Synthetic oligonucleotide
  source 1..21: mol_type = other DNA
cgctaagtggtgatgggggga

SEQ ID NO: 198 - DNA, 21 bp, synthetic construct
  misc_feature 1..21: note = Description of Artificial Sequence: Synthetic oligonucleotide
  source 1..21: mol_type = other DNA
gcagtgaggaaagaccgggtc

SEQ ID NO: 199 - DNA, 21 bp, synthetic construct
  misc_feature 1..21: note = Description of Artificial Sequence: Synthetic oligonucleotide
  source 1..21: mol_type = other DNA
cagagagaagggcagaagtgc

SEQ ID NO: 200 - DNA, 21 bp, synthetic construct
  misc_feature 1..21: note = Description of Artificial Sequence: Synthetic oligonucleotide
  source 1..21: mol_type = other DNA
gaactggccggctggcctggg

SEQ ID NO: 201 - DNA, 21 bp, synthetic construct
  misc_feature 1..21: note = Description of Artificial Sequence: Synthetic oligonucleotide
  source 1..21: mol_type = other DNA
gtgcccttccagagagaaggg

SEQ ID NO: 202 - DNA, 21 bp, synthetic construct
  misc_feature 1..21: note = Description of Artificial Sequence: Synthetic oligonucleotide
  source 1..21: mol_type = other DNA
gagaccttcgacagcctcacg

SEQ ID NO: 203 - DNA, 21 bp, synthetic construct
  misc_feature 1..21: note = Description of Artificial Sequence: Synthetic oligonucleotide
  source 1..21: mol_type = other DNA
ctggaccagatcaaccagcgg

SEQ ID NO: 204 - DNA, 21 bp, synthetic construct
  misc_feature 1..21: note = Description of Artificial Sequence: Synthetic oligonucleotide
  source 1..21: mol_type = other DNA
cccccctgcacccggctgcag

SEQ ID NO: 205 - DNA, 21 bp, synthetic construct
  misc_feature 1..21: note = Description of Artificial Sequence: Synthetic oligonucleotide
  source 1..21: mol_type = other DNA
caccagcgtctggaagggcag

SEQ ID NO: 206 - DNA, 21 bp, synthetic construct
  misc_feature 1..21: note = Description of Artificial Sequence: Synthetic oligonucleotide
  source 1..21: mol_type = other DNA
ctgccgctggttgatctggtc

SEQ ID NO: 207 - DNA, 21 bp, synthetic construct
  misc_feature 1..21: note = Description of Artificial Sequence: Synthetic oligonucleotide
  source 1..21: mol_type = other DNA
tggcagatggcgtggcaggag

SEQ ID NO: 208 - DNA, 21 bp, synthetic construct
  misc_feature 1..21: note = Description of Artificial Sequence: Synthetic oligonucleotide
  source 1..21: mol_type = other DNA
ctggctcggcccagtcgcaag

SEQ ID NO: 209 - DNA, 21 bp, synthetic construct
  misc_feature 1..21: note = Description of Artificial Sequence: Synthetic oligonucleotide
  source 1..21: mol_type = other DNA
aggtggatgatggtgccgtcg

SEQ ID NO: 210 - DNA, 21 bp, synthetic construct
  misc_feature 1..21: note = Description of Artificial Sequence: Synthetic oligonucleotide
  source 1..21: mol_type = other DNA
gggagacctgattcgggagat

SEQ ID NO: 211 - DNA, 21 bp, synthetic construct
  misc_feature 1..21: note = Description of Artificial Sequence: Synthetic oligonucleotide
  source 1..21: mol_type = other DNA
aatgaactgggcgatggccac

SEQ ID NO: 212 - DNA, 21 bp, synthetic construct
  misc_feature 1..21: note = Description of Artificial Sequence: Synthetic oligonucleotide
  source 1..21: mol_type = other DNA
tctaggtggtaccatggccac

SEQ ID NO: 213 - DNA, 21 bp, synthetic construct
  misc_feature 1..21: note = Description of Artificial Sequence: Synthetic oligonucleotide
  source 1..21: mol_type = other DNA
caggtctccccgctggacaat

SEQ ID NO: 214 - DNA, 21 bp, synthetic construct
  misc_feature 1..21: note = Description of Artificial Sequence: Synthetic oligonucleotide
  source 1..21: mol_type = other DNA
gggtggcacatctccccatcc

SEQ ID NO: 215 - DNA, 21 bp, synthetic construct
  misc_feature 1..21: note = Description of Artificial Sequence: Synthetic oligonucleotide
  source 1..21: mol_type = other DNA
tgcagagaaaggtggctctat

SEQ ID NO: 216 - DNA, 21 bp, synthetic construct
  misc_feature 1..21: note = Description of Artificial Sequence: Synthetic oligonucleotide
  source 1..21: mol_type = other DNA
taatgctgacttggggtggca

SEQ ID NO: 217 - DNA, 21 bp, synthetic construct
  misc_feature 1..21: note = Description of Artificial Sequence: Synthetic oligonucleotide
  source 1..21: mol_type = other DNA
ctcctgaggtcaccttccaca

SEQ ID NO: 218 - DNA, 21 bp, synthetic construct
  misc_feature 1..21: note = Description of Artificial Sequence: Synthetic oligonucleotide
  source 1..21: mol_type = other DNA
ctaagaaacagtgagccttgt

SEQ ID NO: 219 - DNA, 21 bp, synthetic construct
  misc_feature 1..21: note = Description of Artificial Sequence: Synthetic oligonucleotide
  source 1..21: mol_type = other DNA
cctctttgccccaacccaggc

SEQ ID NO: 220 - DNA, 21 bp, synthetic construct
  misc_feature 1..21: note = Description of Artificial Sequence: Synthetic oligonucleotide
  source 1..21: mol_type = other DNA
aggtttccttgagtggcaggc

SEQ ID NO: 221 - DNA, 21 bp, synthetic construct
  misc_feature 1..21: note = Description of Artificial Sequence: Synthetic oligonucleotide
  source 1..21: mol_type = other DNA
agaatcaaaatcggtgaatag

SEQ ID NO: 222 - DNA, 21 bp, synthetic construct
  misc_feature 1..21: note = Description of Artificial Sequence: Synthetic oligonucleotide
  source 1..21: mol_type = other DNA
ccccttactgctcttctaggc

SEQ ID NO: 223 - DNA, 21 bp, synthetic construct
  misc_feature 1..21: note = Description of Artificial Sequence: Synthetic oligonucleotide
  source 1..21: mol_type = other DNA
ggtggcaatggataaggccga

SEQ ID NO: 224 - DNA, 21 bp, synthetic construct
  misc_feature 1..21: note = Description of Artificial Sequence: Synthetic oligonucleotide
  source 1..21: mol_type = other DNA
gaactataaatcagaacacct

SEQ ID NO: 225 - DNA, 21 bp, synthetic construct
  misc_feature 1..21: note = Description of Artificial Sequence: Synthetic oligonucleotide
  source 1..21: mol_type = other DNA
tttctcagaagagcctggcta

SEQ ID NO: 226 - DNA, 21 bp, synthetic construct
  misc_feature 1..21: note = Description of Artificial Sequence: Synthetic oligonucleotide
  source 1..21: mol_type = other DNA
cccgtgtcattctctggactg

SEQ ID NO: 227 - DNA, 21 bp, synthetic construct
  misc_feature 1..21: note = Description of Artificial Sequence: Synthetic oligonucleotide
  source 1..21: mol_type = other DNA
ctgggcctttttcccatgcct

SEQ ID NO: 228 - DNA, 21 bp, synthetic construct
  misc_feature 1..21: note = Description of Artificial Sequence: Synthetic oligonucleotide
  source 1..21: mol_type = other DNA
aactataaatcagaacacctg

SEQ ID NO: 229 - DNA, 21 bp, synthetic construct
  misc_feature 1..21: note = Description of Artificial Sequence: Synthetic oligonucleotide
  source 1..21: mol_type = other DNA
attctcaaacaaatgtgtcac

SEQ ID NO: 230 - DNA, 21 bp, synthetic construct
  misc_feature 1..21: note = Description of Artificial Sequence: Synthetic oligonucleotide
  source 1..21: mol_type = other DNA
cttgagtggcaggccaggcct

SEQ ID NO: 231 - DNA, 21 bp, synthetic construct
  misc_feature 1..21: note = Description of Artificial Sequence: Synthetic oligonucleotide
  source 1..21: mol_type = other DNA
catgtgcaaacgccttcaaca

SEQ ID NO: 232 - DNA, 21 bp, synthetic construct
  misc_feature 1..21: note = Description of Artificial Sequence: Synthetic oligonucleotide
  source 1..21: mol_type = other DNA
tactaagaaacagtgagcctt

SEQ ID NO: 233 - DNA, 21 bp, synthetic construct
  misc_feature 1..21: note = Description of Artificial Sequence: Synthetic oligonucleotide
  source 1..21: mol_type = other DNA
ctcagactgtttgccccttac

SEQ ID NO: 234 - DNA, 21 bp, synthetic construct
  misc_feature 1..21: note = Description of Artificial Sequence: Synthetic oligonucleotide
  source 1..21: mol_type = other DNA
taattcctccacttcaacacc

SEQ ID NO: 235 - DNA, 21 bp, synthetic construct
  misc_feature 1..21: note = Description of Artificial Sequence: Synthetic oligonucleotide
  source 1..21: mol_type = other DNA
ataggatcttcttcaaaaccc

SEQ ID NO: 236 - DNA, 21 bp, synthetic construct
  misc_feature 1..21: note = Description of Artificial Sequence: Synthetic oligonucleotide
  source 1..21: mol_type = other DNA
gaagaagatcctattaaataa

SEQ ID NO: 237 - DNA, 21 bp, synthetic construct
  misc_feature 1..21: note = Description of Artificial Sequence: Synthetic oligonucleotide
  source 1..21: mol_type = other DNA
tgtttttaatgtgactctcat

SEQ ID NO: 238 - DNA, 21 bp, synthetic construct
  misc_feature 1..21: note = Description of Artificial Sequence: Synthetic oligonucleotide
  source 1..21: mol_type = other DNA
gtactttacagtttattaaat

SEQ ID NO: 239 - DNA, 21 bp, synthetic construct
  misc_feature 1..21: note = Description of Artificial Sequence: Synthetic oligonucleotide
  source 1..21: mol_type = other DNA
ataaactgtaaagtaccaaac

SEQ ID NO: 240 - DNA, 21 bp, synthetic construct
  misc_feature 1..21: note = Description of Artificial Sequence: Synthetic oligonucleotide
  source 1..21: mol_type = other DNA
gacttttcccagctgacagat

SEQ ID NO: 241 - DNA, 21 bp, synthetic construct
  misc_feature 1..21: note = Description of Artificial Sequence: Synthetic oligonucleotide
  source 1..21: mol_type = other DNA
cccagctgacagatgggctcc

SEQ ID NO: 242 - DNA, 21 bp, synthetic construct
  misc_feature 1..21: note = Description of Artificial Sequence: Synthetic oligonucleotide
  source 1..21: mol_type = other DNA
gtggtgtcactggcggcggcc

SEQ ID NO: 243 - DNA, 21 bp, synthetic construct
  misc_feature 1..21: note = Description of Artificial Sequence: Synthetic oligonucleotide
  source 1..21: mol_type = other DNA
gccatcaccatcagcaccggg

SEQ ID NO: 244 - DNA, 21 bp, synthetic construct
  misc_feature 1..21: note = Description of Artificial Sequence: Synthetic oligonucleotide
  source 1..21: mol_type = other DNA
gtcctggtcctcacgcagagc

SEQ ID NO: 245 - DNA, 21 bp, synthetic construct
  misc_feature 1..21: note = Description of Artificial Sequence: Synthetic oligonucleotide
  source 1..21: mol_type = other DNA
gccctcgtgccggtcaccaag

SEQ ID NO: 246 - DNA, 21 bp, synthetic construct
  misc_feature 1..21: note = Description of Artificial Sequence: Synthetic oligonucleotide
  source 1..21: mol_type = other DNA
gctgaccgcagttgttccaac

SEQ ID NO: 247 - DNA, 21 bp, synthetic construct
  misc_feature 1..21: note = Description of Artificial Sequence: Synthetic oligonucleotide
  source 1..21: mol_type = other DNA
ggctgaccgcagttgttccaa

SEQ ID NO: 248 - DNA, 21 bp, synthetic construct
  misc_feature 1..21: note = Description of Artificial Sequence: Synthetic oligonucleotide
  source 1..21: mol_type = other DNA
gccctccccgcagccctggga

SEQ ID NO: 249 - DNA, 21 bp, synthetic construct
  misc_feature 1..21: note = Description of Artificial Sequence: Synthetic oligonucleotide
  source 1..21: mol_type = other DNA
aacttctttgcctgtgtgctg

SEQ ID NO: 250 - DNA, 21 bp, synthetic construct
  misc_feature 1..21: note = Description of Artificial Sequence: Synthetic oligonucleotide
  source 1..21: mol_type = other DNA
tttgcctgtgtgctggtgccc

SEQ ID NO: 251 - DNA, 21 bp, synthetic construct
  misc_feature 1..21: note = Description of Artificial Sequence: Synthetic oligonucleotide
  source 1..21: mol_type = other DNA
cctgtgtgctggtgcccctgc

SEQ ID NO: 252 - DNA, 21 bp, synthetic construct
  misc_feature 1..21: note = Description of Artificial Sequence: Synthetic oligonucleotide
  source 1..21: mol_type = other DNA
agctgtcgtcgcgccgccagg

SEQ ID NO: 253 - DNA, 21 bp, synthetic construct
  misc_feature 1..21: note = Description of Artificial Sequence: Synthetic oligonucleotide
  source 1..21: mol_type = other DNA
tgcagtgtggaccgtgcccgc

SEQ ID NO: 254 - DNA, 21 bp, synthetic construct
  misc_feature 1..21: note = Description of Artificial Sequence: Synthetic oligonucleotide
  source 1..21: mol_type = other DNA
gcagcatggacctccttctgc

SEQ ID NO: 255 - DNA, 21 bp, synthetic construct
  misc_feature 1..21: note = Description of Artificial Sequence: Synthetic oligonucleotide
  source 1..21: mol_type = other DNA
ccctctgctggctgcccctac

SEQ ID NO: 256 - DNA, 21 bp, synthetic construct
  misc_feature 1..21: note = Description of Artificial Sequence: Synthetic oligonucleotide
  source 1..21: mol_type = other DNA
actttcttctgccccgactgc

SEQ ID NO: 257 - DNA, 21 bp, synthetic construct
  misc_feature 1..21: note = Description of Artificial Sequence: Synthetic oligonucleotide
  source 1..21: mol_type = other DNA
cttctgccccgactgcagcca

SEQ ID NO: 258 - DNA, 21 bp, synthetic construct
  misc_feature 1..21: note = Description of Artificial Sequence: Synthetic oligonucleotide
  source 1..21: mol_type = other DNA
atctacgcctaccgtatccgc

SEQ ID NO: 259 - DNA, 21 bp, synthetic construct
  misc_feature 1..21: note = Description of Artificial Sequence: Synthetic oligonucleotide
  source 1..21: mol_type = other DNA
cgcaagatcattcgcagccac

SEQ ID NO: 260 - DNA, 21 bp, synthetic construct
  misc_feature 1..21: note = Description of Artificial Sequence: Synthetic oligonucleotide
  source 1..21: mol_type = other DNA
aaaggttcttgctgcctcagg

SEQ ID NO: 261 - DNA, 21 bp, synthetic construct
  misc_feature 1..21: note = Description of Artificial Sequence: Synthetic oligonucleotide
  source 1..21: mol_type = other DNA
caaggcagctggcaccagtgc

SEQ ID NO: 262 - DNA, 21 bp, synthetic construct
  misc_feature 1..21: note = Description of Artificial Sequence: Synthetic oligonucleotide
  source 1..21: mol_type = other DNA
agctcatggctaaggagctcc

SEQ ID NO: 263 - DNA, 21 bp, synthetic construct
  misc_feature 1..21: note = Description of Artificial Sequence: Synthetic oligonucleotide
  source 1..21: mol_type = other DNA
gccatgagctcaagggagtgt

SEQ ID NO: 264 - DNA, 21 bp, synthetic construct
  misc_feature 1..21: note = Description of Artificial Sequence: Synthetic oligonucleotide
  source 1..21: mol_type = other DNA
cccgatattcctcaggtactc

SEQ ID NO: 265 - DNA, 21 bp, synthetic construct
  misc_feature 1..21: note = Description of Artificial Sequence: Synthetic oligonucleotide
  source 1..21: mol_type = other DNA
ccattctctgctggatgacgt

SEQ ID NO: 266 - DNA, 21 bp, synthetic construct
  misc_feature 1..21: note = Description of Artificial Sequence: Synthetic oligonucleotide
  source 1..21: mol_type = other DNA
aatgtcggatggatgaaaccc

SEQ ID NO: 267 - DNA, 21 bp, synthetic construct
  misc_feature 1..21: note = Description of Artificial Sequence: Synthetic oligonucleotide
  source 1..21: mol_type = other DNA
tcaattctctctccattcttc

SEQ ID NO: 268 - DNA, 21 bp, synthetic construct
  misc_feature 1..21: note = Description of Artificial Sequence: Synthetic oligonucleotide
  source 1..21: mol_type = other DNA
ttcaattctctctccattctt

SEQ ID NO: 269 - DNA, 21 bp, synthetic construct
  misc_feature 1..21: note = Description of Artificial Sequence: Synthetic oligonucleotide
  source 1..21: mol_type = other DNA
ctgaaagacaagtctgaatgc

SEQ ID NO: 270 - DNA, 21 bp, synthetic construct
  misc_feature 1..21: note = Description of Artificial Sequence: Synthetic oligonucleotide
  source 1..21: mol_type = other DNA
tctttcagcaaggactggtct

SEQ ID NO: 271 - DNA, 21 bp, synthetic construct
  misc_feature 1..21: note = Description of Artificial Sequence: Synthetic oligonucleotide
  source 1..21: mol_type = other DNA
agcaaggactggtctttctat

SEQ ID NO: 272 - DNA, 21 bp, synthetic construct
  misc_feature 1..21: note = Description of Artificial Sequence: Synthetic oligonucleotide
  source 1..21: mol_type = other DNA
actatcttgggctgtgacaaa

SEQ ID NO: 273 - DNA, 21 bp, synthetic construct
  misc_feature 1..21: note = Description of Artificial Sequence: Synthetic oligonucleotide
  source 1..21: mol_type = other DNA
gtcacagcccaagatagttaa

SEQ ID NO: 274 - DNA, 21 bp, synthetic construct
  misc_feature 1..21: note = Description of Artificial Sequence: Synthetic oligonucleotide
  source 1..21: mol_type = other DNA
tcctcctacagatacaaactg

SEQ ID NO: 275 - DNA, 21 bp, synthetic construct
  misc_feature 1..21: note = Description of Artificial Sequence: Synthetic oligonucleotide
  source 1..21: mol_type = other DNA
gtcctgagagtccagtttgta

SEQ ID NO: 276 - DNA, 21 bp, synthetic construct
  misc_feature 1..21: note = Description of Artificial Sequence: Synthetic oligonucleotide
  source 1..21: mol_type = other DNA
tgttgctggatgctgaggggc

SEQ ID NO: 277 - DNA, 21 bp, synthetic construct
  misc_feature 1..21: note = Description of Artificial Sequence: Synthetic oligonucleotide
  source 1..21: mol_type = other DNA
ccttttcttcgtggccaatgc

SEQ ID NO: 278 - DNA, 21 bp, synthetic construct
  misc_feature 1..21: note = Description of Artificial Sequence: Synthetic oligonucleotide
  source 1..21: mol_type = other DNA
tcttcgtggccaatgccataa

SEQ ID NO: 279 - DNA, 21 bp, synthetic construct
  misc_feature 1..21: note = Description of Artificial Sequence: Synthetic oligonucleotide
  source 1..21: mol_type = other DNA
cttcgtggccaatgccataat

SEQ ID NO: 280 - DNA, 21 bp, synthetic construct
  misc_feature 1..21: note = Description of Artificial Sequence: Synthetic oligonucleotide
  source 1..21: mol_type = other DNA
gggctctgacaggtaggaccc

SEQ ID NO: 281 - DNA, 21 bp, synthetic construct
  misc_feature 1..21: note = Description of Artificial Sequence: Synthetic oligonucleotide
  source 1..21: mol_type = other DNA
taccttggggctctgacaggt

SEQ ID NO: 282 - DNA, 21 bp, synthetic construct
  misc_feature 1..21: note = Description of Artificial Sequence: Synthetic oligonucleotide
  source 1..21: mol_type = other DNA
ttaccttggggctctgacagg

SEQ ID NO: 283 - skipped

SEQ ID NO: 284 - DNA, 21 bp, synthetic construct
  misc_feature 1..21: note = Description of Artificial Sequence: Synthetic oligonucleotide
  source 1..21: mol_type = other DNA
ttaacagcgatgctgaccccc

SEQ ID NO: 285 - DNA, 21 bp, synthetic construct
  misc_feature 1..21: note = Description of Artificial Sequence: Synthetic oligonucleotide
  source 1..21: mol_type = other DNA
tatgaccagatggacctggct

SEQ ID NO: 286 - DNA, 21 bp, synthetic construct
  misc_feature 1..21: note = Description of Artificial Sequence: Synthetic oligonucleotide
  source 1..21: mol_type = other DNA
tcctcccagaacccgacacag

SEQ ID NO: 287 - DNA, 21 bp, synthetic construct
  misc_feature 1..21: note = Description of Artificial Sequence: Synthetic oligonucleotide
  source 1..21: mol_type = other DNA
cctcccagaacccgacacaga

SEQ ID NO: 288 - DNA, 21 bp, synthetic construct
  misc_feature 1..21: note = Description of Artificial Sequence: Synthetic oligonucleotide
  source 1..21: mol_type = other DNA
catgtcacacaacagcctgct

SEQ ID NO: 289 - DNA, 21 bp, synthetic construct
  misc_feature 1..21: note = Description of Artificial Sequence: Synthetic oligonucleotide
  source 1..21: mol_type = other DNA
ctcaccgatattggcataagc

SEQ ID NO: 290 - DNA, 21 bp, synthetic construct
  misc_feature 1..21: note = Description of Artificial Sequence: Synthetic oligonucleotide
  source 1..21: mol_type = other DNA
tccttgtctgggcagcggaac

SEQ ID NO: 291 - DNA, 21 bp, synthetic construct
  misc_feature 1..21: note = Description of Artificial Sequence: Synthetic oligonucleotide
  source 1..21: mol_type = other DNA
ccttgtctgggcagcggaact

SEQ ID NO: 292 - DNA, 21 bp, synthetic construct
  misc_feature 1..21: note = Description of Artificial Sequence: Synthetic oligonucleotide
  source 1..21: mol_type = other DNA
tctgggcagcggaactggacc

SEQ ID NO: 293 - DNA, 21 bp, synthetic construct
  misc_feature 1..21: note = Description of Artificial Sequence: Synthetic oligonucleotide
  source 1..21: mol_type = other DNA
ctcaggccctccagctgggag

SEQ ID NO: 294 - DNA, 21 bp, synthetic construct
  misc_feature 1..21: note = Description of Artificial Sequence: Synthetic oligonucleotide
  source 1..21: mol_type = other DNA
ctgaaaatgtccttgctcagg

SEQ ID NO: 295 - DNA, 21 bp, synthetic construct
  misc_feature 1..21: note = Description of Artificial Sequence: Synthetic oligonucleotide
  source 1..21: mol_type = other DNA
tctcaaagtagagcacatagg

SEQ ID NO: 296 - DNA, 21 bp, synthetic construct
  misc_feature 1..21: note = Description of Artificial Sequence: Synthetic oligonucleotide
  source 1..21: mol_type = other DNA
atctggtcctatgtgctctac

SEQ ID NO: 297 - DNA, 21 bp, synthetic construct
  misc_feature 1..21: note = Description of Artificial Sequence: Synthetic oligonucleotide
  source 1..21: mol_type = other DNA
ctgcccaacttctgctggcat

SEQ ID NO: 298 - DNA, 21 bp, synthetic construct
  misc_feature 1..21: note = Description of Artificial Sequence: Synthetic oligonucleotide
  source 1..21: mol_type = other DNA
tctgcccaacttctgctggca

SEQ ID NO: 299 - DNA, 21 bp, synthetic construct
  misc_feature 1..21: note = Description of Artificial Sequence: Synthetic oligonucleotide
  source 1..21: mol_type = other DNA
ctgacttttctgcccaacttc

SEQ ID NO: 300 - DNA, 21 bp, synthetic construct
  misc_feature 1..21: note = Description of Artificial Sequence: Synthetic oligonucleotide
  source 1..21: mol_type = other DNA
ctctgcagccttcccagagga

SEQ ID NO: 301 - DNA, 21 bp, synthetic construct
  misc_feature 1..21: note = Description of Artificial Sequence: Synthetic oligonucleotide
  source 1..21: mol_type = other DNA
ccagaggagcttccggcagac

SEQ ID NO: 302 - DNA, 21 bp, synthetic construct
  misc_feature 1..21: note = Description of Artificial Sequence: Synthetic oligonucleotide
  source 1..21: mol_type = other DNA
aggtctgccggaagctcctct

SEQ ID NO: 303 - DNA, 21 bp, synthetic construct
  misc_feature 1..21: note = Description of Artificial Sequence: Synthetic oligonucleotide
  source 1..21: mol_type = other DNA
cagtgcttcaggtctgccgga

SEQ ID NO: 304 - DNA, 21 bp, synthetic construct
  misc_feature 1..21: note = Description of Artificial Sequence: Synthetic oligonucleotide
  source 1..21: mol_type = other DNA
cggcagacctgaagcactgga

SEQ ID NO: 305 - DNA, 21 bp, synthetic construct
  misc_feature 1..21: note = Description of Artificial Sequence: Synthetic oligonucleotide
  source 1..21: mol_type = other DNA
ctcacagctgagccccccact

SEQ ID NO: 306 - DNA, 21 bp, synthetic construct
  misc_feature 1..21: note = Description of Artificial Sequence: Synthetic oligonucleotide
  source 1..21: mol_type = other DNA
ctccaggcgcatctggccgga

SEQ ID NO: 307 - DNA, 21 bp, synthetic construct
  misc_feature 1..21: note = Description of Artificial Sequence: Synthetic oligonucleotide
  source 1..21: mol_type = other DNA
tctcttgcagtgcctttctcc

SEQ ID NO: 308 - DNA, 21 bp, synthetic construct
  misc_feature 1..21: note = Description of Artificial Sequence: Synthetic oligonucleotide
  source 1..21: mol_type = other DNA
ctccagttcctcgttgagctg

SEQ ID NO: 309 - DNA, 21 bp, synthetic construct
  misc_feature 1..21: note = Description of Artificial Sequence: Synthetic oligonucleotide
  source 1..21: mol_type = other DNA
tgccgctgaaatccaaggcaa

SEQ ID NO: 310 - DNA, 21 bp, synthetic construct
  misc_feature 1..21: note = Description of Artificial Sequence: Synthetic oligonucleotide
  source 1..21: mol_type = other DNA
ccttggatttcagcggcacaa

SEQ ID NO: 311 - DNA, 21 bp, synthetic construct
  misc_feature 1..21: note = Description of Artificial Sequence: Synthetic oligonucleotide
  source 1..21: mol_type = other DNA
gatttcagcggcacaaggctc

SEQ ID NO: 312 - DNA, 21 bp, synthetic construct
  misc_feature 1..21: note = Description of Artificial Sequence: Synthetic oligonucleotide
  source 1..21: mol_type = other DNA
gcagaagacagggatgaagag

SEQ ID NO: 313 - DNA, 21 bp, synthetic construct
  misc_feature 1..21: note = Description of Artificial Sequence: Synthetic oligonucleotide
  source 1..21: mol_type = other DNA
ggcttttccatgctagcaatg

SEQ ID NO: 314 - DNA, 21 bp, synthetic construct
  misc_feature 1..21: note = Description of Artificial Sequence: Synthetic oligonucleotide
  source 1..21: mol_type = other DNA
gcttttccatgctagcaatgc

SEQ ID NO: 315 - DNA, 21 bp, synthetic construct
  misc_feature 1..21: note = Description of Artificial Sequence: Synthetic oligonucleotide
  source 1..21: mol_type = other DNA
tccatgctagcaatgcacgtg

SEQ ID NO: 316 - DNA, 21 bp, synthetic construct
  misc_feature 1..21: note = Description of Artificial Sequence: Synthetic oligonucleotide
  source 1..21: mol_type = other DNA
ccatgctagcaatgcacgtgg

SEQ ID NO: 317 - DNA, 21 bp, synthetic construct
  misc_feature 1..21: note = Description of Artificial Sequence: Synthetic oligonucleotide
  source 1..21: mol_type = other DNA
gtgtgtgagtatgcatctcca

SEQ ID NO: 318 - DNA, 21 bp, synthetic construct
  misc_feature 1..21: note = Description of Artificial Sequence: Synthetic oligonucleotide
  source 1..21: mol_type = other DNA
gcctggagatgcatactcaca

SEQ ID NO: 319 - DNA, 21 bp, synthetic construct
  misc_feature 1..21: note = Description of Artificial Sequence: Synthetic oligonucleotide
  source 1..21: mol_type = other DNA
ggcaggctgacagccaggtga

SEQ ID NO: 320 - DNA, 21 bp, synthetic construct
  misc_feature 1..21: note = Description of Artificial Sequence: Synthetic oligonucleotide
  source 1..21: mol_type = other DNA
agtcacctggctgtcagcctg

SEQ ID NO: 321 - DNA, 21 bp, synthetic construct
  misc_feature 1..21: note = Description of Artificial Sequence: Synthetic oligonucleotide
  source 1..21: mol_type = other DNA
atttccactggaggtgcccgt

SEQ ID NO: 322 - DNA, 21 bp, synthetic construct
  misc_feature 1..21: note = Description of Artificial Sequence: Synthetic oligonucleotide
  source 1..21: mol_type = other DNA
gatagtgaggttcacttgatt

SEQ ID NO: 323 - DNA, 21 bp, synthetic construct
  misc_feature 1..21: note = Description of Artificial Sequence: Synthetic oligonucleotide
  source 1..21: mol_type = other DNA
cagatgtagagtcccgtgtcc

SEQ ID NO: 324 - DNA, 21 bp, synthetic construct
  misc_feature 1..21: note = Description of Artificial Sequence: Synthetic oligonucleotide
  source 1..21: mol_type = other DNA
ctcaccaattacataaatctg

SEQ ID NO: 325 - DNA, 21 bp, synthetic construct
  misc_feature 1..21: note = Description of Artificial Sequence: Synthetic oligonucleotide
  source 1..21: mol_type = other DNA
gctcaccaattacataaatct

SEQ ID NO: 326 - DNA, 21 bp, synthetic construct
  misc_feature 1..21: note = Description of Artificial Sequence: Synthetic oligonucleotide
  source 1..21: mol_type = other DNA
gttttctgttgcagatccaga

SEQ ID NO: 327 - DNA, 21 bp, synthetic construct
  misc_feature 1..21: note = Description of Artificial Sequence: Synthetic oligonucleotide
  source 1..21: mol_type = other DNA
ttttctgttgcagatccagaa

SEQ ID NO: 328 - DNA, 21 bp, synthetic construct
  misc_feature 1..21: note = Description of Artificial Sequence: Synthetic oligonucleotide
  source 1..21: mol_type = other DNA
cagcagttagttcggggttgt

SEQ ID NO: 329 - DNA, 21 bp, synthetic construct
  misc_feature 1..21: note = Description of Artificial Sequence: Synthetic oligonucleotide
  source 1..21: mol_type = other DNA
tttatagctttctcctcacag

SEQ ID NO: 330 - DNA, 21 bp, synthetic construct
  misc_feature 1..21: note = Description of Artificial Sequence: Synthetic oligonucleotide
  source 1..21: mol_type = other DNA
ctcctcacagctgtttctttg

SEQ ID NO: 331 - DNA, 21 bp, synthetic construct
  misc_feature 1..21: note = Description of Artificial Sequence: Synthetic oligonucleotide
  source 1..21: mol_type = other DNA
tcctcacagctgtttctttga

SEQ ID NO: 332 - DNA, 21 bp, synthetic construct
  misc_feature 1..21: note = Description of Artificial Sequence: Synthetic oligonucleotide
  source 1..21: mol_type = other DNA
gctcaaagaaacagctgtgag

SEQ ID NO: 333 - DNA, 21 bp, synthetic construct
  misc_feature 1..21: note = Description of Artificial Sequence: Synthetic oligonucleotide
  source 1..21: mol_type = other DNA
tttttgtgtttgacagctaaa

SEQ ID NO: 334 - DNA, 21 bp, synthetic construct
  misc_feature 1..21: note = Description of Artificial Sequence: Synthetic oligonucleotide
  source 1..21: mol_type = other DNA
tgtgtttgacagctaaagaaa

SEQ ID NO: 335 - DNA, 21 bp, synthetic construct
  misc_feature 1..21: note = Description of Artificial Sequence: Synthetic oligonucleotide
  source 1..21: mol_type = other DNA
cacattctggctctgttgggg

SEQ ID NO: 336 - DNA, 21 bp, synthetic construct
  misc_feature 1..21: note = Description of Artificial Sequence: Synthetic oligonucleotide
  source 1..21: mol_type = other DNA
tcacattctggctctgttggg

SEQ ID NO: 337 - DNA, 21 bp, synthetic construct
  misc_feature 1..21: note = Description of Artificial Sequence: Synthetic oligonucleotide
  source 1..21: mol_type = other DNA
agccttattttattcccatca

SEQ ID NO: 338 - DNA, 21 bp, synthetic construct
  misc_feature 1..21: note = Description of Artificial Sequence: Synthetic oligonucleotide
  source 1..21: mol_type = other DNA
tcttgggcggggtggccattc

SEQ ID NO: 339 - DNA, 21 bp, synthetic construct
  misc_feature 1..21: note = Description of Artificial Sequence: Synthetic oligonucleotide
  source 1..21: mol_type = other DNA
cttgatgcgggtcccctcaga

SEQ ID NO: 340 - DNA, 21 bp, synthetic construct
  misc_feature 1..21: note = Description of Artificial Sequence: Synthetic oligonucleotide
  source 1..21: mol_type = other DNA
gatggagattttcttgatgcg

SEQ ID NO: 341 - DNA, 21 bp, synthetic construct
  misc_feature 1..21: note = Description of Artificial Sequence: Synthetic oligonucleotide
  source 1..21: mol_type = other DNA
ccgatgttcccttcgatggag

SEQ ID NO: 342 - DNA, 21 bp, synthetic construct
  misc_feature 1..21: note = Description of Artificial Sequence: Synthetic oligonucleotide
  source 1..21: mol_type = other DNA
tgaatatccttaaacaattgt

SEQ ID NO: 343 - DNA, 21 bp, synthetic construct
  misc_feature 1..21: note = Description of Artificial Sequence: Synthetic oligonucleotide
  source 1..21: mol_type = other DNA
ccaatcttcacacaattgttt

SEQ ID NO: 344 - DNA, 21 bp, synthetic construct
  misc_feature 1..21: note = Description of Artificial Sequence: Synthetic oligonucleotide
  source 1..21: mol_type = other DNA
aacaattgtgtgaagattggg

SEQ ID NO: 345 - DNA, 21 bp, synthetic construct
  misc_feature 1..21: note = Description of Artificial Sequence: Synthetic oligonucleotide
  source 1..21: mol_type = other DNA
aacattgcaccatctggcaac

SEQ ID NO: 346 - DNA, 21 bp, synthetic construct
  misc_feature 1..21: note = Description of Artificial Sequence: Synthetic oligonucleotide
  source 1..21: mol_type = other DNA
gaacattgcaccatctggcaa

SEQ ID NO: 347 - DNA, 21 bp, synthetic construct
  misc_feature 1..21: note = Description of Artificial Sequence: Synthetic oligonucleotide
  source 1..21: mol_type = other DNA
catacctcaaattcatcttga

SEQ ID NO: 348 - DNA, 21 bp, synthetic construct
  misc_feature 1..21: note = Description of Artificial Sequence: Synthetic oligonucleotide
  source 1..21: mol_type = other DNA
attttcatacctcaaattcat

SEQ ID NO: 349 - DNA, 21 bp, synthetic construct
  misc_feature 1..21: note = Description of Artificial Sequence: Synthetic oligonucleotide
  source 1..21: mol_type = other DNA
aattttattttcatacctcaa

SEQ ID NO: 350 - DNA, 21 bp, synthetic construct
  misc_feature 1..21: note = Description of Artificial Sequence: Synthetic oligonucleotide
  source 1..21: mol_type = other DNA
tgcacattcaaaataggaact

SEQ ID NO: 351 - DNA, 21 bp, synthetic construct
  misc_feature 1..21: note = Description of Artificial Sequence: Synthetic oligonucleotide
  source 1..21: mol_type = other DNA
tctgagacattgtaagttcct

SEQ ID NO: 352 - DNA, 21 bp, synthetic construct
  misc_feature 1..21: note = Description of Artificial Sequence: Synthetic oligonucleotide
  source 1..21: mol_type = other DNA
caatgtctcagaaaaatggtg

SEQ ID NO: 353 - DNA, 21 bp, synthetic construct
  misc_feature 1..21: note = Description of Artificial Sequence: Synthetic oligonucleotide
  source 1..21: mol_type = other DNA
accttccaaacatatgcctgt

SEQ ID NO: 354 - DNA, 21 bp, synthetic construct
  misc_feature 1..21: note = Description of Artificial Sequence: Synthetic oligonucleotide
  source 1..21: mol_type = other DNA
caaacatatgcctgtctcagt

SEQ ID NO: 355 - DNA, 21 bp, synthetic construct
  misc_feature 1..21: note = Description of Artificial Sequence: Synthetic oligonucleotide
  source 1..21: mol_type = other DNA
ccattcagagaggcaagctga

SEQ ID NO: 356 - DNA, 21 bp, synthetic construct
  misc_feature 1..21: note = Description of Artificial Sequence: Synthetic oligonucleotide
  source 1..21: mol_type = other DNA
cctctctgaatggcaagctca

SEQ ID NO: 357 - DNA, 21 bp, synthetic construct
  misc_feature 1..21: note = Description of Artificial Sequence: Synthetic oligonucleotide
  source 1..21: mol_type = other DNA
tctgcatctttgagcttgcca

SEQ ID NO: 358 - DNA, 21 bp, synthetic construct
  misc_feature 1..21: note = Description of Artificial Sequence: Synthetic oligonucleotide
  source 1..21: mol_type = other DNA
ttgaacgatctgtgtatagtg

SEQ ID NO: 359 - DNA, 21 bp, synthetic construct
  misc_feature 1..21: note = Description of Artificial Sequence: Synthetic oligonucleotide
  source 1..21: mol_type = other DNA
aggtatatttttgcatctaat

SEQ ID NO: 360 - DNA, 21 bp, synthetic construct
  misc_feature 1..21: note = Description of Artificial Sequence: Synthetic oligonucleotide
  source 1..21: mol_type = other DNA
tattttacaggttcttacgtc

SEQ ID NO: 361 - DNA, 21 bp, synthetic construct
  misc_feature 1..21: note = Description of Artificial Sequence: Synthetic oligonucleotide
  source 1..21: mol_type = other DNA
attttacaggttcttacgtct

SEQ ID NO: 362 - DNA, 21 bp, synthetic construct
  misc_feature 1..21: note = Description of Artificial Sequence: Synthetic oligonucleotide
  source 1..21: mol_type = other DNA
tggacgataatctagcaacag

SEQ ID NO: 363 - DNA, 21 bp, synthetic construct
  misc_feature 1..21: note = Description of Artificial Sequence: Synthetic oligonucleotide
  source 1..21: mol_type = other DNA
ggcattaacacttttggacga

SEQ ID NO: 364 - DNA, 21 bp, synthetic construct
  misc_feature 1..21: note = Description of Artificial Sequence: Synthetic oligonucleotide
  source 1..21: mol_type = other DNA
gagttgatgtcagtcacttgg

SEQ ID NO: 365 - DNA, 21 bp, synthetic construct
  misc_feature 1..21: note = Description of Artificial Sequence: Synthetic oligonucleotide
  source 1..21: mol_type = other DNA
caagttctgagtctcaactgt

SEQ ID NO: 366 - DNA, 21 bp, synthetic construct
  misc_feature 1..21: note = Description of Artificial Sequence: Synthetic oligonucleotide
  source 1..21: mol_type = other DNA
tggcagaattggccatcatga

SEQ ID NO: 367 - DNA, 21 bp, synthetic construct
  misc_feature 1..21: note = Description of Artificial Sequence: Synthetic oligonucleotide
  source 1..21: mol_type = other DNA
tttccttgggcaggtgaaagg

SEQ ID NO: 368 - DNA, 21 bp, synthetic construct
  misc_feature 1..21: note = Description of Artificial Sequence: Synthetic oligonucleotide
  source 1..21: mol_type = other DNA
ttggcagggcacgcagtctgg

SEQ ID NO: 369 - DNA, 21 bp, synthetic construct
  misc_feature 1..21: note = Description of Artificial Sequence: Synthetic oligonucleotide
  source 1..21: mol_type = other DNA
ccttcttggcagggcacgcag

SEQ ID NO: 370 - DNA, 21 bp, synthetic construct
  misc_feature 1..21: note = Description of Artificial Sequence: Synthetic oligonucleotide
  source 1..21: mol_type = other DNA
tctgtgtactccttcccttct

SEQ ID NO: 371 - DNA, 21 bp, synthetic construct
  misc_feature 1..21: note = Description of Artificial Sequence: Synthetic oligonucleotide
  source 1..21: mol_type = other DNA
gtctgtgtactccttcccttc

SEQ ID NO: 372 - DNA, 21 bp, synthetic construct
  misc_feature 1..21: note = Description of Artificial Sequence: Synthetic oligonucleotide
  source 1..21: mol_type = other DNA
gaagaaaaatgggctttgtct

SEQ ID NO: 373 - DNA, 21 bp, synthetic construct
  misc_feature 1..21: note = Description of Artificial Sequence: Synthetic oligonucleotide
  source 1..21: mol_type = other DNA
tcttccaaatgcagaagatgt

SEQ ID NO: 374 - DNA, 21 bp, synthetic construct
  misc_feature 1..21: note = Description of Artificial Sequence: Synthetic oligonucleotide
  source 1..21: mol_type = other DNA
atcacacaatctacatcttct

SEQ ID NO: 375 - DNA, 21 bp, synthetic construct
  misc_feature 1..21: note = Description of Artificial Sequence: Synthetic oligonucleotide
  source 1..21: mol_type = other DNA
aagactcttaccatgtccttc

SEQ ID NO: 376 - DNA, 21 bp, synthetic construct
  misc_feature 1..21: note = Description of Artificial Sequence: Synthetic oligonucleotide
  source 1..21: mol_type = other DNA
caaactgattttctaggctta

SEQ ID NO: 377 - DNA, 21 bp, synthetic construct
  misc_feature 1..21: note = Description of Artificial Sequence: Synthetic oligonucleotide
  source 1..21: mol_type = other DNA
gaagtggaaataaactgcacc

SEQ ID NO: 378 - DNA, 21 bp, synthetic construct
  misc_feature 1..21: note = Description of Artificial Sequence: Synthetic oligonucleotide
  source 1..21: mol_type = other DNA
gtattctgggtccgggtgcag

SEQ ID NO: 379 - DNA, 21 bp, synthetic construct
  misc_feature 1..21: note = Description of Artificial Sequence: Synthetic oligonucleotide
  source 1..21: mol_type = other DNA
catctgcacttggtattctgg

SEQ ID NO: 380 - DNA, 21 bp, synthetic construct
  misc_feature 1..21: note = Description of Artificial Sequence: Synthetic oligonucleotide
  source 1..21: mol_type = other DNA
ttttgtaactctactgtatgt

SEQ ID NO: 381 - DNA, 21 bp, synthetic construct
  misc_feature 1..21: note = Description of Artificial Sequence: Synthetic oligonucleotide
  source 1..21: mol_type = other DNA
tttgtaactctactgtatgtg

SEQ ID NO: 382 - DNA, 21 bp, synthetic construct
  misc_feature 1..21: note = Description of Artificial Sequence: Synthetic oligonucleotide
  source 1..21: mol_type = other DNA
cacttggtgttgctggtgagt

SEQ ID NO: 383 - DNA, 21 bp, synthetic construct
  misc_feature 1..21: note = Description of Artificial Sequence: Synthetic oligonucleotide
  source 1..21: mol_type = other DNA
gggtggctttgtcttcttctt

SEQ ID NO: 384 - DNA, 21 bp, synthetic construct
  misc_feature 1..21: note = Description of Artificial Sequence: Synthetic oligonucleotide
  source 1..21: mol_type = other DNA
gtcttcttcttttgccaattc

SEQ ID NO: 385 - DNA, 21 bp, synthetic construct
  misc_feature 1..21: note = Description of Artificial Sequence: Synthetic oligonucleotide
  source 1..21: mol_type = other DNA
tcttcttcttttgccaattcc

SEQ ID NO: 386 - DNA, 21 bp, synthetic construct
  misc_feature 1..21: note = Description of Artificial Sequence: Synthetic oligonucleotide
  source 1..21: mol_type = other DNA
gccaattccactaattgtttg

SEQ ID NO: 387 - DNA, 21 bp, synthetic construct
  misc_feature 1..21: note = Description of Artificial Sequence: Synthetic oligonucleotide
  source 1..21: mol_type = other DNA
ccccaaacaattagtggaatt

SEQ ID NO: 388 - DNA, 21 bp, synthetic construct
  misc_feature 1..21: note = Description of Artificial Sequence: Synthetic oligonucleotide
  source 1..21: mol_type = other DNA
aacaaagcaagaacttacccc

SEQ ID NO: 389 - DNA, 21 bp, synthetic construct
  misc_feature 1..21: note = Description of Artificial Sequence: Synthetic oligonucleotide
  source 1..21: mol_type = other DNA
ttctttcagtgaagagaaagg

SEQ ID NO: 390 - DNA, 21 bp, synthetic construct
  misc_feature 1..21: note = Description of Artificial Sequence: Synthetic oligonucleotide
  source 1..21: mol_type = other DNA
ctgtacttcctttctcttcac

SEQ ID NO: 391 - DNA, 21 bp, synthetic construct
  misc_feature 1..21: note = Description of Artificial Sequence: Synthetic oligonucleotide
  source 1..21: mol_type = other DNA
tgcatgttttctgtacttcct

SEQ ID NO: 392 - DNA, 21 bp, synthetic construct
  misc_feature 1..21: note = Description of Artificial Sequence: Synthetic oligonucleotide
  source 1..21: mol_type = other DNA
ctgcatgttttctgtacttcc

SEQ ID NO: 393 - DNA, 21 bp, synthetic construct
  misc_feature 1..21: note = Description of Artificial Sequence: Synthetic oligonucleotide
  source 1..21: mol_type = other DNA
tgtgctttctgcatgttttct

SEQ ID NO: 394 - DNA, 21 bp, synthetic construct
  misc_feature 1..21: note = Description of Artificial Sequence: Synthetic oligonucleotide
  source 1..21: mol_type = other DNA
ctgtgctttctgcatgttttc

SEQ ID NO: 395 - DNA, 21 bp, synthetic construct
  misc_feature 1..21: note = Description of Artificial Sequence: Synthetic oligonucleotide
  source 1..21: mol_type = other DNA
cctttctgtgctttctgcatg

SEQ ID NO: 396 - DNA, 21 bp, synthetic construct
  misc_feature 1..21: note = Description of Artificial Sequence: Synthetic oligonucleotide
  source 1..21: mol_type = other DNA
gttttcctttctgtgctttct

SEQ ID NO: 397 - DNA, 21 bp, synthetic construct
  misc_feature 1..21: note = Description of Artificial Sequence: Synthetic oligonucleotide
  source 1..21: mol_type = other DNA
aagttggagattcatgagaac

SEQ ID NO: 398 - DNA, 21 bp, synthetic construct
  misc_feature 1..21: note = Description of Artificial Sequence: Synthetic oligonucleotide
  source 1..21: mol_type = other DNA
aatacctacaggatttaaagt

SEQ ID NO: 399 - DNA, 21 bp, synthetic construct
  misc_feature 1..21: note = Description of Artificial Sequence: Synthetic oligonucleotide
  source 1..21: mol_type = other DNA
ttgctttctaggaaacagtgg

SEQ ID NO: 400 - DNA, 21 bp, synthetic construct
  misc_feature 1..21: note = Description of Artificial Sequence: Synthetic oligonucleotide
  source 1..21: mol_type = other DNA
ctaggaaacagtggcaataaa

SEQ ID NO: 401 - DNA, 21 bp, synthetic construct
  misc_feature 1..21: note = Description of Artificial Sequence: Synthetic oligonucleotide
  source 1..21: mol_type = other DNA
ccagataaatttattgccact

SEQ ID NO: 402 - DNA, 21 bp, synthetic construct
  misc_feature 1..21: note = Description of Artificial Sequence: Synthetic oligonucleotide
  source 1..21: mol_type = other DNA
ctatttttcagatgttgactt

SEQ ID NO: 403 - DNA, 21 bp, synthetic construct
  misc_feature 1..21: note = Description of Artificial Sequence: Synthetic oligonucleotide
  source 1..21: mol_type = other DNA
tcagatgttgacttgagtaaa

SEQ ID NO: 404 - DNA, 21 bp, synthetic construct
  misc_feature 1..21: note = Description of Artificial Sequence: Synthetic oligonucleotide
  source 1..21: mol_type = other DNA
agtaaatatatcaccactatt

SEQ ID NO: 405 - DNA, 21 bp, synthetic construct
  misc_feature 1..21: note = Description of Artificial Sequence: Synthetic oligonucleotide
  source 1..21: mol_type = other DNA
aacttgacttagtgtcatgac

SEQ ID NO: 406 - DNA, 21 bp, synthetic construct
  misc_feature 1..21: note = Description of Artificial Sequence: Synthetic oligonucleotide
  source 1..21: mol_type = other DNA
gaacaaagcctttaacttgac

SEQ ID NO: 407 - DNA, 21 bp, synthetic construct
  misc_feature 1..21: note = Description of Artificial Sequence: Synthetic oligonucleotide
  source 1..21: mol_type = other DNA
gttcgaaagaatggtgtcaat

SEQ ID NO: 408 - DNA, 21 bp, synthetic construct
  misc_feature 1..21: note = Description of Artificial Sequence: Synthetic oligonucleotide
  source 1..21: mol_type = other DNA
attgacaccattctttcgaac

SEQ ID NO: 409 - DNA, 21 bp, synthetic construct
  misc_feature 1..21: note = Description of Artificial Sequence: Synthetic oligonucleotide
  source 1..21: mol_type = other DNA
ttcgaaagaatggtgtcaatg

SEQ ID NO: 410 - DNA, 21 bp, synthetic construct
  misc_feature 1..21: note = Description of Artificial Sequence: Synthetic oligonucleotide
  source 1..21: mol_type = other DNA
ggcttcattgacaccattctt

SEQ ID NO: 411 - DNA, 21 bp, synthetic construct
  misc_feature 1..21: note = Description of Artificial Sequence: Synthetic oligonucleotide
  source 1..21: mol_type = other DNA
gtaattggcatcaacttcatg

SEQ ID NO: 412 - DNA, 21 bp, synthetic construct
  misc_feature 1..21: note = Description of Artificial Sequence: Synthetic oligonucleotide
  source 1..21: mol_type = other DNA
catgaagttgatgccaattac

SEQ ID NO: 413 - DNA, 21 bp, synthetic construct
  misc_feature 1..21: note = Description of Artificial Sequence: Synthetic oligonucleotide
  source 1..21: mol_type = other DNA
tttccatgaagttgatgccaa

SEQ ID NO: 414 - DNA, 21 bp, synthetic construct
  misc_feature 1..21: note = Description of Artificial Sequence: Synthetic oligonucleotide
  source 1..21: mol_type = other DNA
tttctttccatgaagttgatg

SEQ ID NO: 415 - DNA, 21 bp, synthetic construct
  misc_feature 1..21: note = Description of Artificial Sequence: Synthetic oligonucleotide
  source 1..21: mol_type = other DNA
atggaaagaaagaagcgtatg

SEQ ID NO: 416 - DNA, 21 bp, synthetic construct
  misc_feature 1..21: note = Description of Artificial Sequence: Synthetic oligonucleotide
  source 1..21: mol_type = other DNA
atcaatgtgtcatacgcttct

SEQ ID NO: 417 - DNA, 21 bp, synthetic construct
  misc_feature 1..21: note = Description of Artificial Sequence: Synthetic oligonucleotide
  source 1..21: mol_type = other DNA
ttgagatctttaatcaatgtg

SEQ ID NO: 418 - DNA, 21 bp, synthetic construct
  misc_feature 1..21: note = Description of Artificial Sequence: Synthetic oligonucleotide
  source 1..21: mol_type = other DNA
tttgagatctttaatcaatgt

SEQ ID NO: 419 - DNA, 21 bp, synthetic construct
  misc_feature 1..21: note = Description of Artificial Sequence: Synthetic oligonucleotide
  source 1..21: mol_type = other DNA
ctctgcaagagtacaaagatt

SEQ ID NO: 420 - DNA, 21 bp, synthetic construct
  misc_feature 1..21: note = Description of Artificial Sequence: Synthetic oligonucleotide
  source 1..21: mol_type = other DNA
tactcttgcagagaaaattca

SEQ ID NO: 421 - DNA, 21 bp, synthetic construct
  misc_feature 1..21: note = Description of Artificial Sequence: Synthetic oligonucleotide
  source 1..21: mol_type = other DNA
aggatgatagtctgaattttc

SEQ ID NO: 422 - DNA, 21 bp, synthetic construct
  misc_feature 1..21: note = Description of Artificial Sequence: Synthetic oligonucleotide
  source 1..21: mol_type = other DNA
ctgagtcactagtaatgtcct

SEQ ID NO: 423 - DNA, 21 bp, synthetic construct
  misc_feature 1..21: note = Description of Artificial Sequence: Synthetic oligonucleotide
  source 1..21: mol_type = other DNA
aattttctgagtcactagtaa

SEQ ID NO: 424 - DNA, 21 bp, synthetic construct
  misc_feature 1..21: note = Description of Artificial Sequence: Synthetic oligonucleotide
  source 1..21: mol_type = other DNA
tgaagtttgaattttctgagt

SEQ ID NO: 425 - DNA, 21 bp, synthetic construct
  misc_feature 1..21: note = Description of Artificial Sequence: Synthetic oligonucleotide
  source 1..21: mol_type = other DNA
atttctgaagtttgaattttc

SEQ ID NO: 426 - DNA, 21 bp, synthetic construct
  misc_feature 1..21: note = Description of Artificial Sequence: Synthetic oligonucleotide
  source 1..21: mol_type = other DNA
gatttcatttctgaagtttga

SEQ ID NO: 427 - DNA, 21 bp, synthetic construct
  misc_feature 1..21: note = Description of Artificial Sequence: Synthetic oligonucleotide
  source 1..21: mol_type = other DNA
ggatttcatttctgaagtttg

SEQ ID NO: 428 - DNA, 21 bp, synthetic construct
  misc_feature 1..21: note = Description of Artificial Sequence: Synthetic oligonucleotide
  source 1..21: mol_type = other DNA
agaaatgaaatccaaagcttg

SEQ ID NO: 429 - DNA, 21 bp, synthetic construct
  misc_feature 1..21: note = Description of Artificial Sequence: Synthetic oligonucleotide
  source 1..21: mol_type = other DNA
tcactctagaccaagctttgg

SEQ ID NO: 430 - DNA, 21 bp, synthetic construct
  misc_feature 1..21: note = Description of Artificial Sequence: Synthetic oligonucleotide
  source 1..21: mol_type = other DNA
ttgtttttcactctagaccaa

SEQ ID NO: 431 - DNA, 21 bp, synthetic construct
  misc_feature 1..21: note = Description of Artificial Sequence: Synthetic oligonucleotide
  source 1..21: mol_type = other DNA
gtctagagtgaaaaacaacaa

SEQ ID NO: 432 - DNA, 21 bp, synthetic construct
  misc_feature 1..21: note = Description of Artificial Sequence: Synthetic oligonucleotide
  source 1..21: mol_type = other DNA
tcttctgcaagctccatgttt

SEQ ID NO: 433 - DNA, 21 bp, synthetic construct
  misc_feature 1..21: note = Description of Artificial Sequence: Synthetic oligonucleotide
  source 1..21: mol_type = other DNA
tcttctgcaagctccatgttt

SEQ ID NO: 434 - DNA, 21 bp, synthetic construct
  misc_feature 1..21: note = Description of Artificial Sequence: Synthetic oligonucleotide
  source 1..21: mol_type = other DNA
cttctgcaagctccatgtttt

SEQ ID NO: 435 - DNA, 21 bp, synthetic construct
  misc_feature 1..21: note = Description of Artificial Sequence: Synthetic oligonucleotide
  source 1..21: mol_type = other DNA
cacatcttccctttgactgtg

SEQ ID NO: 436 - DNA, 21 bp, synthetic construct
  misc_feature 1..21: note = Description of Artificial Sequence: Synthetic oligonucleotide
  source 1..21: mol_type = other DNA
gactgtgtcctgctgctgctg

SEQ ID NO: 437 - DNA, 21 bp, synthetic construct
  misc_feature 1..21: note = Description of Artificial Sequence: Synthetic oligonucleotide
  source 1..21: mol_type = other DNA
tctctctatgcagggtcctca

SEQ ID NO: 438 - DNA, 21 bp, synthetic construct
  misc_feature 1..21: note = Description of Artificial Sequence: Synthetic oligonucleotide
  source 1..21: mol_type = other DNA
tacaccccagccgccccaggg

SEQ ID NO: 439 - DNA, 21 bp, synthetic construct
  misc_feature 1..21: note = Description of Artificial Sequence: Synthetic oligonucleotide
  source 1..21: mol_type = other DNA
gccccagcagacgggcacgag

SEQ ID NO: 440 - DNA, 21 bp, synthetic construct
  misc_feature 1..21: note = Description of Artificial Sequence: Synthetic oligonucleotide
  source 1..21: mol_type = other DNA
catcagtcctgagcaccacgt

SEQ ID NO: 441 - DNA, 21 bp, synthetic construct
  misc_feature 1..21: note = Description of Artificial Sequence: Synthetic oligonucleotide
  source 1..21: mol_type = other DNA
cggaaatccccatttagccag

SEQ ID NO: 442 - DNA, 21 bp, synthetic construct
  misc_feature 1..21: note = Description of Artificial Sequence: Synthetic oligonucleotide
  source 1..21: mol_type = other DNA
gcggaaatccccatttagcca

SEQ ID NO: 443 - DNA, 21 bp, synthetic construct
  misc_feature 1..21: note = Description of Artificial Sequence: Synthetic oligonucleotide
  source 1..21: mol_type = other DNA
tcatcattcattatgcctggg

SEQ ID NO: 444 - DNA, 21 bp, synthetic construct
  misc_feature 1..21: note = Description of Artificial Sequence: Synthetic oligonucleotide
  source 1..21: mol_type = other DNA
aggttaaatttttcatcattc

SEQ ID NO: 445 - DNA, 21 bp, synthetic construct
  misc_feature 1..21: note = Description of Artificial Sequence: Synthetic oligonucleotide
  source 1..21: mol_type = other DNA
atgaccaacttcaggttaaat

SEQ ID NO: 446 - DNA, 21 bp, synthetic construct
  misc_feature 1..21: note = Description of Artificial Sequence: Synthetic oligonucleotide
  source 1..21: mol_type = other DNA
tgttgtttctgacattagcca

SEQ ID NO: 447 - DNA, 21 bp, synthetic construct
  misc_feature 1..21: note = Description of Artificial Sequence: Synthetic oligonucleotide
  source 1..21: mol_type = other DNA
gaaaggctgcagtgaagtctc

SEQ ID NO: 448 - DNA, 21 bp, synthetic construct
  misc_feature 1..21: note = Description of Artificial Sequence: Synthetic oligonucleotide
  source 1..21: mol_type = other DNA
tatagcagagacacagacact

SEQ ID NO: 449 - DNA, 21 bp, synthetic construct
  misc_feature 1..21: note = Description of Artificial Sequence: Synthetic oligonucleotide
  source 1..21: mol_type = other DNA
ctgttagatttatatcaggga

SEQ ID NO: 450 - DNA, 21 bp, synthetic construct
  misc_feature 1..21: note = Description of Artificial Sequence: Synthetic oligonucleotide
  source 1..21: mol_type = other DNA
catagcaaatatccacattgg

SEQ ID NO: 451 - DNA, 21 bp, synthetic construct
  misc_feature 1..21: note = Description of Artificial Sequence: Synthetic oligonucleotide
  source 1..21: mol_type = other DNA
aaaattaaagcgccgaagata

SEQ ID NO: 452 - DNA, 21 bp, synthetic construct
  misc_feature 1..21: note = Description of Artificial Sequence: Synthetic oligonucleotide
  source 1..21: mol_type = other DNA
catttgaaaattaaagcgccg

SEQ ID NO: 453 - DNA, 21 bp, synthetic construct
  misc_feature 1..21: note = Description of Artificial Sequence: Synthetic oligonucleotide
  source 1..21: mol_type = other DNA
tgtttcccccttactagggta

SEQ ID NO: 454 - DNA, 21 bp, synthetic construct
  misc_feature 1..21: note = Description of Artificial Sequence: Synthetic oligonucleotide
  source 1..21: mol_type = other DNA
aattctgtatcttctctttgc

SEQ ID NO: 455 - DNA, 21 bp, synthetic construct
  misc_feature 1..21: note = Description of Artificial Sequence: Synthetic oligonucleotide
  source 1..21: mol_type = other DNA
atttccacagcctcatctctt

SEQ ID NO: 456 - DNA, 21 bp, synthetic construct
  misc_feature 1..21: note = Description of Artificial Sequence: Synthetic oligonucleotide
  source 1..21: mol_type = other DNA
tttccacagcctcatctcttt

SEQ ID NO: 457 - DNA, 21 bp, synthetic construct
  misc_feature 1..21: note = Description of Artificial Sequence: Synthetic oligonucleotide
  source 1..21: mol_type = other DNA
cacagcctcatctctttggcc

SEQ ID NO: 458 - DNA, 21 bp, synthetic construct
  misc_feature 1..21: note = Description of Artificial Sequence: Synthetic oligonucleotide
  source 1..21: mol_type = other DNA
cttctgagcgaattccctctg

SEQ ID NO: 459 - DNA, 21 bp, synthetic construct
  misc_feature 1..21: note = Description of Artificial Sequence: Synthetic oligonucleotide
  source 1..21: mol_type = other DNA
atatacgttctcttcaatggt

SEQ ID NO: 460 - DNA, 21 bp, synthetic construct
  misc_feature 1..21: note = Description of Artificial Sequence: Synthetic oligonucleotide
  source 1..21: mol_type = other DNA
gggttgtcgctttgcaatgcc

SEQ ID NO: 461 - DNA, 21 bp, synthetic construct
  misc_feature 1..21: note = Description of Artificial Sequence: Synthetic oligonucleotide
  source 1..21: mol_type = other DNA
ctgtttctgcagccgctttgg

SEQ ID NO: 462 - DNA, 21 bp, synthetic construct
  misc_feature 1..21: note = Description of Artificial Sequence: Synthetic oligonucleotide
  source 1..21: mol_type = other DNA
tgcagccgctttgggtggctc

SEQ ID NO: 463 - DNA, 21 bp, synthetic construct
  misc_feature 1..21: note = Description of Artificial Sequence: Synthetic oligonucleotide
  source 1..21: mol_type = other DNA
gctcacctagtgaagcctctc

SEQ ID NO: 464 - DNA, 21 bp, synthetic construct
  misc_feature 1..21: note = Description of Artificial Sequence: Synthetic oligonucleotide
  source 1..21: mol_type = other DNA
tgcgaagagcaggggtcactt

SEQ ID NO: 465 - DNA, 21 bp, synthetic construct
  misc_feature 1..21: note = Description of Artificial Sequence: Synthetic oligonucleotide
  source 1..21: mol_type = other DNA
ccgcccagtggcccgcccgct

SEQ ID NO: 466 - DNA, 21 bp, synthetic construct
  misc_feature 1..21: note = Description of Artificial Sequence: Synthetic oligonucleotide
  source 1..21: mol_type = other DNA
tcgctatggctgcgcccagcc

SEQ ID NO: 467 - DNA, 21 bp, synthetic construct
  misc_feature 1..21: note = Description of Artificial Sequence: Synthetic oligonucleotide
  source 1..21: mol_type = other DNA
tccttgcacagtgactgccag

SEQ ID NO: 468 - DNA, 21 bp, synthetic construct
  misc_feature 1..21: note = Description of Artificial Sequence: Synthetic oligonucleotide
  source 1..21: mol_type = other DNA
cacagtgactgccagcccccc

SEQ ID NO: 469 - DNA, 21 bp, synthetic construct
  misc_feature 1..21: note = Description of Artificial Sequence: Synthetic oligonucleotide
  source 1..21: mol_type = other DNA
gaactgctccttcagccgccc

SEQ ID NO: 470 - DNA, 21 bp, synthetic construct
  misc_feature 1..21: note = Description of Artificial Sequence: Synthetic oligonucleotide
  source 1..21: mol_type = other DNA
agccgccctgaccgcccagcc

SEQ ID NO: 471 - DNA, 21 bp, synthetic construct
  misc_feature 1..21: note = Description of Artificial Sequence: Synthetic oligonucleotide
  source 1..21: mol_type = other DNA
ccgctaagtggtgatgggggg

SEQ ID NO: 472 - DNA, 21 bp, synthetic construct
  misc_feature 1..21: note = Description of Artificial Sequence: Synthetic oligonucleotide
  source 1..21: mol_type = other DNA
gcggaaagcttcctcttcctg

SEQ ID NO: 473 - DNA, 21 bp, synthetic construct
  misc_feature 1..21: note = Description of Artificial Sequence: Synthetic oligonucleotide
  source 1..21: mol_type = other DNA
ctcttcctgccccaagtcagc

SEQ ID NO: 474 - DNA, 21 bp, synthetic construct
  misc_feature 1..21: note = Description of Artificial Sequence: Synthetic oligonucleotide
  source 1..21: mol_type = other DNA
aacgtctccatcatgtataac

SEQ ID NO: 475 - DNA, 21 bp, synthetic construct
  misc_feature 1..21: note = Description of Artificial Sequence: Synthetic oligonucleotide
  source 1..21: mol_type = other DNA
cttttctcttcaggtctggag

SEQ ID NO: 476 - DNA, 21 bp, synthetic construct
  misc_feature 1..21: note = Description of Artificial Sequence: Synthetic oligonucleotide
  source 1..21: mol_type = other DNA
ctcttcaggtctggagccccc

SEQ ID NO: 477 - DNA, 21 bp, synthetic construct
  misc_feature 1..21: note = Description of Artificial Sequence: Synthetic oligonucleotide
  source 1..21: mol_type = other DNA
acagtgtacgctggagcaggt

SEQ ID NO: 478 - DNA, 21 bp, synthetic construct
  misc_feature 1..21: note = Description of Artificial Sequence: Synthetic oligonucleotide
  source 1..21: mol_type = other DNA
ctcactgccaagtggactcct

SEQ ID NO: 479 - DNA, 21 bp, synthetic construct
  misc_feature 1..21: note = Description of Artificial Sequence: Synthetic oligonucleotide
  source 1..21: mol_type = other DNA
acccttcgactagaggatgtg

SEQ ID NO: 480 - DNA, 21 bp, synthetic construct
  misc_feature 1..21: note = Description of Artificial Sequence: Synthetic oligonucleotide
  source 1..21: mol_type = other DNA
gactagaggatgtgagccagg

SEQ ID NO: 481 - DNA, 21 bp, synthetic construct
  misc_feature 1..21: note = Description of Artificial Sequence: Synthetic oligonucleotide
  source 1..21: mol_type = other DNA
cccacctgaggctgacctgtg

SEQ ID NO: 482 - DNA, 21 bp, synthetic construct
  misc_feature 1..21: note = Description of Artificial Sequence: Synthetic oligonucleotide
  source 1..21: mol_type = other DNA
tactcttttcagtgactccca

SEQ ID NO: 483 - DNA, 21 bp, synthetic construct
  misc_feature 1..21: note = Description of Artificial Sequence: Synthetic oligonucleotide
  source 1..21: mol_type = other DNA
cagtgactcccaaatcctttg

SEQ ID NO: 484 - DNA, 21 bp, synthetic construct
  misc_feature 1..21: note = Description of Artificial Sequence: Synthetic oligonucleotide
  source 1..21: mol_type = other DNA
gggtcacctggatccctgggg

SEQ ID NO: 485 - DNA, 21 bp, synthetic construct
  misc_feature 1..21: note = Description of Artificial Sequence: Synthetic oligonucleotide
  source 1..21: mol_type = other DNA
gtgaggtgactccagtatctg

SEQ ID NO: 486 - DNA, 21 bp, synthetic construct
  misc_feature 1..21: note = Description of Artificial Sequence: Synthetic oligonucleotide
  source 1..21: mol_type = other DNA
gtgtggagctctctggacacc

SEQ ID NO: 487 - DNA, 21 bp, synthetic construct
  misc_feature 1..21: note = Description of Artificial Sequence: Synthetic oligonucleotide
  source 1..21: mol_type = other DNA
gctggaggcacaggaggccca

SEQ ID NO: 488 - DNA, 21 bp, synthetic construct
  misc_feature 1..21: note = Description of Artificial Sequence: Synthetic oligonucleotide
  source 1..21: mol_type = other DNA
cccagccttggcaatgccagc

SEQ ID NO: 489 - DNA, 21 bp, synthetic construct
  misc_feature 1..21: note = Description of Artificial Sequence: Synthetic oligonucleotide
  source 1..21: mol_type = other DNA
gcaatgccagctgtaccaggg

SEQ ID NO: 490 - DNA, 21 bp, synthetic construct
  misc_feature 1..21: note = Description of Artificial Sequence: Synthetic oligonucleotide
  source 1..21: mol_type = other DNA
ttggagcagcagtgtacttca

SEQ ID NO: 491 - DNA, 21 bp, synthetic construct
  misc_feature 1..21: note = Description of Artificial Sequence: Synthetic oligonucleotide
  source 1..21: mol_type = other DNA
acagagctgtctagcccaggt

SEQ ID NO: 492 - DNA, 21 bp, synthetic construct
  misc_feature 1..21: note = Description of Artificial Sequence: Synthetic oligonucleotide
  source 1..21: mol_type = other DNA
ctccataggtgcccaacgctc

SEQ ID NO: 493 - DNA, 21 bp, synthetic construct
  misc_feature 1..21: note = Description of Artificial Sequence: Synthetic oligonucleotide
  source 1..21: mol_type = other DNA
tcatccttggtgtcctttctc

SEQ ID NO: 494 - DNA, 21 bp, synthetic construct
  misc_feature 1..21: note = Description of Artificial Sequence: Synthetic oligonucleotide
  source 1..21: mol_type = other DNA
gtgtcctttctctgctccttt

SEQ ID NO: 495 - DNA, 21 bp, synthetic construct
  misc_feature 1..21: note = Description of Artificial Sequence: Synthetic oligonucleotide
  source 1..21: mol_type = other DNA
ctctgctccttttggtgactg

SEQ ID NO: 496 - DNA, 21 bp, synthetic construct
  misc_feature 1..21: note = Description of Artificial Sequence: Synthetic oligonucleotide
  source 1..21: mol_type = other DNA
tctgctccttttggtgactgg

SEQ ID NO: 497 - DNA, 21 bp, synthetic construct
  misc_feature 1..21: note = Description of Artificial Sequence: Synthetic oligonucleotide
  source 1..21: mol_type = other DNA
tggtgactggagcctttggct

SEQ ID NO: 498 - DNA, 21 bp, synthetic construct
  misc_feature 1..21: note = Description of Artificial Sequence: Synthetic oligonucleotide
  source 1..21: mol_type = other DNA
ggtgactggagcctttggctt

SEQ ID NO: 499 - DNA, 21 bp, synthetic construct
  misc_feature 1..21: note = Description of Artificial Sequence: Synthetic oligonucleotide
  source 1..21: mol_type = other DNA
ggctttcacctttggagaaga

SEQ ID NO: 500 - DNA, 21 bp, synthetic construct
  misc_feature 1..21: note = Description of Artificial Sequence: Synthetic oligonucleotide
  source 1..21: mol_type = other DNA
gctttcacctttggagaagac

SEQ ID NO: 501 - DNA, 21 bp, synthetic construct
  misc_feature 1..21: note = Description of Artificial Sequence: Synthetic oligonucleotide
  source 1..21: mol_type = other DNA
ctctaaggcagaaaatcgtct

SEQ ID NO: 502 - DNA, 21 bp, synthetic construct
  misc_feature 1..21: note = Description of Artificial Sequence: Synthetic oligonucleotide
  source 1..21: mol_type = other DNA
ctgccttagagcaagggattc

SEQ ID NO: 503 - DNA, 21 bp, synthetic construct
  misc_feature 1..21: note = Description of Artificial Sequence: Synthetic oligonucleotide
  source 1..21: mol_type = other DNA
gagcaagggattcaccctccg

SEQ ID NO: 504 - DNA, 21 bp, synthetic construct
  misc_feature 1..21: note = Description of Artificial Sequence: Synthetic oligonucleotide
  source 1..21: mol_type = other DNA
aacctgacctgggacagtttc

SEQ ID NO: 505 - DNA, 21 bp, synthetic construct
  misc_feature 1..21: note = Description of Artificial Sequence: Synthetic oligonucleotide
  source 1..21: mol_type = other DNA
cgctcacctccgcctgagcag

SEQ ID NO: 506 - DNA, 21 bp, synthetic construct
  misc_feature 1..21: note = Description of Artificial Sequence: Synthetic oligonucleotide
  source 1..21: mol_type = other DNA
tccactgctcaggcggaggtg

SEQ ID NO: 507 - DNA, 21 bp, synthetic construct
  misc_feature 1..21: note = Description of Artificial Sequence: Synthetic oligonucleotide
  source 1..21: mol_type = other DNA
tccccagccctgctcgtggtg

SEQ ID NO: 508 - DNA, 21 bp, synthetic construct
  misc_feature 1..21: note = Description of Artificial Sequence: Synthetic oligonucleotide
  source 1..21: mol_type = other DNA
ggtcaccacgagcagggctgg

SEQ ID NO: 509 - DNA, 21 bp, synthetic construct
  misc_feature 1..21: note = Description of Artificial Sequence: Synthetic oligonucleotide
  source 1..21: mol_type = other DNA
acctgcagcttctccaacaca

SEQ ID NO: 510 - DNA, 21 bp, synthetic construct
  misc_feature 1..21: note = Description of Artificial Sequence: Synthetic oligonucleotide
  source 1..21: mol_type = other DNA
tccaacacatcggagagcttc

SEQ ID NO: 511 - DNA, 21 bp, synthetic construct
  misc_feature 1..21: note = Description of Artificial Sequence: Synthetic oligonucleotide
  source 1..21: mol_type = other DNA
gtgctaaactggtaccgcatg

SEQ ID NO: 512 - DNA, 21 bp, synthetic construct
  misc_feature 1..21: note = Description of Artificial Sequence: Synthetic oligonucleotide
  source 1..21: mol_type = other DNA
tccgtctggttgctggggctc

SEQ ID NO: 513 - DNA, 21 bp, synthetic construct
  misc_feature 1..21: note = Description of Artificial Sequence: Synthetic oligonucleotide
  source 1..21: mol_type = other DNA
cccgaggaccgcagccagccc

SEQ ID NO: 514 - DNA, 21 bp, synthetic construct
  misc_feature 1..21: note = Description of Artificial Sequence: Synthetic oligonucleotide
  source 1..21: mol_type = other DNA
cgtgtcacacaactgcccaac

SEQ ID NO: 515 - DNA, 21 bp, synthetic construct
  misc_feature 1..21: note = Description of Artificial Sequence: Synthetic oligonucleotide
  source 1..21: mol_type = other DNA
cacatgagcgtggtcagggcc

SEQ ID NO: 516 - DNA, 21 bp, synthetic construct
  misc_feature 1..21: note = Description of Artificial Sequence: Synthetic oligonucleotide
  source 1..21: mol_type = other DNA
gatctgcgccttgggggccag

SEQ ID NO: 517 - DNA, 21 bp, synthetic construct
  misc_feature 1..21: note = Description of Artificial Sequence: Synthetic oligonucleotide
  source 1..21: mol_type = other DNA
atctgcgccttgggggccagg

SEQ ID NO: 518 - DNA, 21 bp, synthetic construct
  misc_feature 1..21: note = Description of Artificial Sequence: Synthetic oligonucleotide
  source 1..21: mol_type = other DNA
ggggccagggagatggcccca

SEQ ID NO: 519 - DNA, 21 bp, synthetic construct
  misc_feature 1..21: note = Description of Artificial Sequence: Synthetic oligonucleotide
  source 1..21: mol_type = other DNA
tgcccttccagagagaagggc

SEQ ID NO: 520 - DNA, 21 bp, synthetic construct
  misc_feature 1..21: note = Description of Artificial Sequence: Synthetic oligonucleotide
  source 1..21: mol_type = other DNA
tgcccttctctctggaagggc

SEQ ID NO: 521 - DNA, 21 bp, synthetic construct
  misc_feature 1..21: note = Description of Artificial Sequence: Synthetic oligonucleotide
  source 1..21: mol_type = other DNA
ctcctcaaagaaggaggaccc

SEQ ID NO: 522 - DNA, 21 bp, synthetic construct
  misc_feature 1..21: note = Description of Artificial Sequence: Synthetic oligonucleotide
  source 1..21: mol_type = other DNA
tcctcaaagaaggaggacccc

SEQ ID NO: 523 - DNA, 21 bp, synthetic construct
  misc_feature 1..21: note = Description of Artificial Sequence: Synthetic oligonucleotide
  source 1..21: mol_type = other DNA
tctcgccactggaaatccagc

SEQ ID NO: 524 - DNA, 21 bp, synthetic construct
  misc_feature 1..21: note = Description of Artificial Sequence: Synthetic oligonucleotide
  source 1..21: mol_type = other DNA
cctagcggaatgggcacctca

SEQ ID NO: 525 - DNA, 21 bp, synthetic construct
  misc_feature 1..21: note = Description of Artificial Sequence: Synthetic oligonucleotide
  source 1..21: mol_type = other DNA
gcccctctgaccggcttcctt

SEQ ID NO: 526 - DNA, 21 bp, synthetic construct
  misc_feature 1..21: note = Description of Artificial Sequence: Synthetic oligonucleotide
  source 1..21: mol_type = other DNA
agcagggtctctgcatccagc

SEQ ID NO: 527 - DNA, 21 bp, synthetic construct
  misc_feature 1..21: note = Description of Artificial Sequence: Synthetic oligonucleotide
  source 1..21: mol_type = other DNA
cctgacgctgccttctctagg

SEQ ID NO: 528 - DNA, 21 bp, synthetic construct
  misc_feature 1..21: note = Description of Artificial Sequence: Synthetic oligonucleotide
  source 1..21: mol_type = other DNA
gcctgcagcagcgtctctgcc

SEQ ID NO: 529 - DNA, 21 bp, synthetic construct
  misc_feature 1..21: note = Description of Artificial Sequence: Synthetic oligonucleotide
  source 1..21: mol_type = other DNA
gtgctttctgtgctcagtgac

SEQ ID NO: 530 - DNA, 21 bp, synthetic construct
  misc_feature 1..21: note = Description of Artificial Sequence: Synthetic oligonucleotide
  source 1..21: mol_type = other DNA
ctgtgctcagtgaccagccca

SEQ ID NO: 531 - DNA, 21 bp, synthetic construct
  misc_feature 1..21: note = Description of Artificial Sequence: Synthetic oligonucleotide
  source 1..21: mol_type = other DNA
atgtgggtgaccctgagcggg

SEQ ID NO: 532 - DNA, 21 bp, synthetic construct
  misc_feature 1..21: note = Description of Artificial Sequence: Synthetic oligonucleotide
  source 1..21: mol_type = other DNA
cctcgcacatgaccttgatgt

SEQ ID NO: 533 - DNA, 21 bp, synthetic construct
  misc_feature 1..21: note = Description of Artificial Sequence: Synthetic oligonucleotide
  source 1..21: mol_type = other DNA
gacagcctcacggacctggtg

SEQ ID NO: 534 - DNA, 21 bp, synthetic construct
  misc_feature 1..21: note = Description of Artificial Sequence: Synthetic oligonucleotide
  source 1..21: mol_type = other DNA
ttgttcagttccaacactcgg

SEQ ID NO: 535 - DNA, 21 bp, synthetic construct
  misc_feature 1..21: note = Description of Artificial Sequence: Synthetic oligonucleotide
  source 1..21: mol_type = other DNA
gctgtatcctcggactcctgc

SEQ ID NO: 536 - DNA, 21 bp, synthetic construct
  misc_feature 1..21: note = Description of Artificial Sequence: Synthetic oligonucleotide
  source 1..21: mol_type = other DNA
cagacgctggtgcaagttctt

SEQ ID NO: 537 - DNA, 21 bp, synthetic construct
  misc_feature 1..21: note = Description of Artificial Sequence: Synthetic oligonucleotide
  source 1..21: mol_type = other DNA
ttctctggccgctgcccttcc

SEQ ID NO: 538 - DNA, 21 bp, synthetic construct
  misc_feature 1..21: note = Description of Artificial Sequence: Synthetic oligonucleotide
  source 1..21: mol_type = other DNA
atgtagttggcattgatgtag

SEQ ID NO: 539 - DNA, 21 bp, synthetic construct
  misc_feature 1..21: note = Description of Artificial Sequence: Synthetic oligonucleotide
  source 1..21: mol_type = other DNA
cgtccagaaccagctgctagg

SEQ ID NO: 540 - DNA, 21 bp, synthetic construct
  misc_feature 1..21: note = Description of Artificial Sequence: Synthetic oligonucleotide
  source 1..21: mol_type = other DNA
tccacctctcgggtggtcatg

SEQ ID NO: 541 - DNA, 21 bp, synthetic construct
  misc_feature 1..21: note = Description of Artificial Sequence: Synthetic oligonucleotide
  source 1..21: mol_type = other DNA
ctccacctctcgggtggtcat

SEQ ID NO: 542 - DNA, 21 bp, synthetic construct
  misc_feature 1..21: note = Description of Artificial Sequence: Synthetic oligonucleotide
  source 1..21: mol_type = other DNA
ccagaacaaatgcgtcccata

SEQ ID NO: 543 - DNA, 21 bp, synthetic construct
  misc_feature 1..21: note = Description of Artificial Sequence: Synthetic oligonucleotide
  source 1..21: mol_type = other DNA
cagaacaaatgcgtcccatac

SEQ ID NO: 544 - DNA, 21 bp, synthetic construct
  misc_feature 1..21: note = Description of Artificial Sequence: Synthetic oligonucleotide
  source 1..21: mol_type = other DNA
tattcggttgtgtcatgctcc

SEQ ID NO: 545 - DNA, 21 bp, synthetic construct
  misc_feature 1..21: note = Description of Artificial Sequence: Synthetic oligonucleotide
  source 1..21: mol_type = other DNA
cctgccgctggttgatctggt

SEQ ID NO: 546 - DNA, 21 bp, synthetic construct
  misc_feature 1..21: note = Description of Artificial Sequence: Synthetic oligonucleotide
  source 1..21: mol_type = other DNA
cccagcgccggcatcggccgc

SEQ ID NO: 547 - DNA, 21 bp, synthetic construct
  misc_feature 1..21: note = Description of Artificial Sequence: Synthetic oligonucleotide
  source 1..21: mol_type = other DNA
gtggagatgttctccatgagc

SEQ ID NO: 548 - DNA, 21 bp, synthetic construct
  misc_feature 1..21: note = Description of Artificial Sequence: Synthetic oligonucleotide
  source 1..21: mol_type = other DNA
tactgcgcctccgtctgcacc

SEQ ID NO: 549 - DNA, 21 bp, synthetic construct
  misc_feature 1..21: note = Description of Artificial Sequence: Synthetic oligonucleotide
  source 1..21: mol_type = other DNA
ttcttagtggtttcaatgaac

SEQ ID NO: 550 - DNA, 21 bp, synthetic construct
  misc_feature 1..21: note = Description of Artificial Sequence: Synthetic oligonucleotide
  source 1..21: mol_type = other DNA
gcatgggcattcttcatggct

SEQ ID NO: 551 - DNA, 21 bp, synthetic construct
  misc_feature 1..21: note = Description of Artificial Sequence: Synthetic oligonucleotide
  source 1..21: mol_type = other DNA
gacgaggtgcgggaggccttg

SEQ ID NO: 552 - DNA, 21 bp, synthetic construct
  misc_feature 1..21: note = Description of Artificial Sequence: Synthetic oligonucleotide
  source 1..21: mol_type = other DNA
gagtctagtgcagggaccgtg

SEQ ID NO: 553 - DNA, 21 bp, synthetic construct
  misc_feature 1..21: note = Description of Artificial Sequence: Synthetic oligonucleotide
  source 1..21: mol_type = other DNA
tgtctgcagccgggtgcaggg

SEQ ID NO: 554 - DNA, 21 bp, synthetic construct
  misc_feature 1..21: note = Description of Artificial Sequence: Synthetic oligonucleotide
  source 1..21: mol_type = other DNA
tcctccctcttgttcttagtg

SEQ ID NO: 555 - DNA, 21 bp, synthetic construct
  misc_feature 1..21: note = Description of Artificial Sequence: Synthetic oligonucleotide
  source 1..21: mol_type = other DNA
ctcctccctcttgttcttagt

SEQ ID NO: 556 - DNA, 21 bp, synthetic construct
  misc_feature 1..21: note = Description of Artificial Sequence: Synthetic oligonucleotide
  source 1..21: mol_type = other DNA
ttcactttctcctccctcttg

SEQ ID NO: 557 - DNA, 21 bp, synthetic construct
  misc_feature 1..21: note = Description of Artificial Sequence: Synthetic oligonucleotide
  source 1..21: mol_type = other DNA
cctgaggcgaggggagcctgc

SEQ ID NO: 558 - DNA, 21 bp, synthetic construct
  misc_feature 1..21: note = Description of Artificial Sequence: Synthetic oligonucleotide
  source 1..21: mol_type = other DNA
gtcctcttccctaggaatgat

SEQ ID NO: 559 - DNA, 21 bp, synthetic construct
  misc_feature 1..21: note = Description of Artificial Sequence: Synthetic oligonucleotide
  source 1..21: mol_type = other DNA
tattgtgcctgtcatcattcc

SEQ ID NO: 560 - DNA, 21 bp, synthetic construct
  misc_feature 1..21: note = Description of Artificial Sequence: Synthetic oligonucleotide
  source 1..21: mol_type = other DNA
tctgcagaaatgttccccgtt

SEQ ID NO: 561 - DNA, 21 bp, synthetic construct
  misc_feature 1..21: note = Description of Artificial Sequence: Synthetic oligonucleotide
  source 1..21: mol_type = other DNA
ctctgcagaaatgttccccgt

SEQ ID NO: 562 - DNA, 21 bp, synthetic construct
  misc_feature 1..21: note = Description of Artificial Sequence: Synthetic oligonucleotide
  source 1..21: mol_type = other DNA
tgccgtggtggaggagaggtg

SEQ ID NO: 563 - DNA, 21 bp, synthetic construct
  misc_feature 1..21: note = Description of Artificial Sequence: Synthetic oligonucleotide
  source 1..21: mol_type = other DNA
tggccatttgtaatgctgact

SEQ ID NO: 564 - DNA, 21 bp, synthetic construct
  misc_feature 1..21: note = Description of Artificial Sequence: Synthetic oligonucleotide
  source 1..21: mol_type = other DNA
aaggatggggagatgtgccac

SEQ ID NO: 565 - DNA, 21 bp, synthetic construct
  misc_feature 1..21: note = Description of Artificial Sequence: Synthetic oligonucleotide
  source 1..21: mol_type = other DNA
aaggatcgagtggccccaggt

SEQ ID NO: 566 - DNA, 21 bp, synthetic construct
  misc_feature 1..21: note = Description of Artificial Sequence: Synthetic oligonucleotide
  source 1..21: mol_type = other DNA
tgcatctatcacacctaccct

SEQ ID NO: 567 - DNA, 21 bp, synthetic construct
  misc_feature 1..21: note = Description of Artificial Sequence: Synthetic oligonucleotide
  source 1..21: mol_type = other DNA
taggacctccaggaagattct

SEQ ID NO: 568 - DNA, 21 bp, synthetic construct
  misc_feature 1..21: note = Description of Artificial Sequence: Synthetic oligonucleotide
  source 1..21: mol_type = other DNA
ctaggacctccaggaagattc

SEQ ID NO: 569 - DNA, 21 bp, synthetic construct
  misc_feature 1..21: note = Description of Artificial Sequence: Synthetic oligonucleotide
  source 1..21: mol_type = other DNA
ctccagcaggaatacctgagc

SEQ ID NO: 570 - DNA, 21 bp, synthetic construct
  misc_feature 1..21: note = Description of Artificial Sequence: Synthetic oligonucleotide
  source 1..21: mol_type = other DNA
gagccatggccgcgacgctgg

SEQ ID NO: 571 - DNA, 21 bp, synthetic construct
  misc_feature 1..21: note = Description of Artificial Sequence: Synthetic oligonucleotide
  source 1..21: mol_type = other DNA
tagtcaacgcgaccaccacga

SEQ ID NO: 572 - DNA, 21 bp, synthetic construct
  misc_feature 1..21: note = Description of Artificial Sequence: Synthetic oligonucleotide
  source 1..21: mol_type = other DNA
ctagtcaacgcgaccaccacg

SEQ ID NO: 573 - DNA, 21 bp, synthetic construct
  misc_feature 1..21: note = Description of Artificial Sequence: Synthetic oligonucleotide
  source 1..21: mol_type = other DNA
tagtttgtttgtttttagaag

SEQ ID NO: 574 - DNA, 21 bp, synthetic construct
  misc_feature 1..21: note = Description of Artificial Sequence: Synthetic oligonucleotide
  source 1..21: mol_type = other DNA
tttgtttttagaagaaagccc

SEQ ID NO: 575 - DNA, 21 bp, synthetic construct
  misc_feature 1..21: note = Description of Artificial Sequence: Synthetic oligonucleotide
  source 1..21: mol_type = other DNA
tttttagaagaaagccctcag

SEQ ID NO: 576 - DNA, 21 bp, synthetic construct
  misc_feature 1..21: note = Description of Artificial Sequence: Synthetic oligonucleotide
  source 1..21: mol_type = other DNA
tagaagaaagccctcagaatc

SEQ ID NO: 577 - DNA, 21 bp, synthetic construct
  misc_feature 1..21: note = Description of Artificial Sequence: Synthetic oligonucleotide
  source 1..21: mol_type = other DNA
cacagaatggattctgagggc

SEQ ID NO: 578 - DNA, 21 bp, synthetic construct
  misc_feature 1..21: note = Description of Artificial Sequence: Synthetic oligonucleotide
  source 1..21: mol_type = other DNA
ctgggggtgagggagcactgg

SEQ ID NO: 579 - DNA, 21 bp, synthetic construct
  misc_feature 1..21: note = Description of Artificial Sequence: Synthetic oligonucleotide
  source 1..21: mol_type = other DNA
tgcctggacacagcttcctgg

SEQ ID NO: 580 - DNA, 21 bp, synthetic construct
  misc_feature 1..21: note = Description of Artificial Sequence: Synthetic oligonucleotide
  source 1..21: mol_type = other DNA
tgtaactcaggacattgaagt

SEQ ID NO: 581 - DNA, 21 bp, synthetic construct
  misc_feature 1..21: note = Description of Artificial Sequence: Synthetic oligonucleotide
  source 1..21: mol_type = other DNA
aatgtcctgagttacagaagc

SEQ ID NO: 582 - DNA, 21 bp, synthetic construct
  misc_feature 1..21: note = Description of Artificial Sequence: Synthetic oligonucleotide
  source 1..21: mol_type = other DNA
gtgtttttaatgtgactctca

SEQ ID NO: 583 - DNA, 21 bp, synthetic construct
  misc_feature 1..21: note = Description of Artificial Sequence: Synthetic oligonucleotide
  source 1..21: mol_type = other DNA
cgtaggattttgtgtttttaa

SEQ ID NO: 584 - DNA, 21 bp, synthetic construct
  misc_feature 1..21: note = Description of Artificial Sequence: Synthetic oligonucleotide
  source 1..21: mol_type = other DNA
cttagtgctgagactcattct

SEQ ID NO: 585 - DNA, 21 bp, synthetic construct
  misc_feature 1..21: note = Description of Artificial Sequence: Synthetic oligonucleotide
  source 1..21: mol_type = other DNA
ccttagtgctgagactcattc

SEQ ID NO: 586 - DNA, 21 bp, synthetic construct
  misc_feature 1..21: note = Description of Artificial Sequence: Synthetic oligonucleotide
  source 1..21: mol_type = other DNA
tttggtactttacagtttatt

SEQ ID NO: 587 - DNA, 21 bp, synthetic construct
  misc_feature 1..21: note = Description of Artificial Sequence: Synthetic oligonucleotide
  source 1..21: mol_type = other DNA
cagtttattaaatagatgttt

SEQ ID NO: 588 - DNA, 21 bp, synthetic construct
  misc_feature 1..21: note = Description of Artificial Sequence: Synthetic oligonucleotide
  source 1..21: mol_type = other DNA
ttaaatagatgtttatatgga

SEQ ID NO: 589 - DNA, 21 bp, synthetic construct
  misc_feature 1..21: note = Description of Artificial Sequence: Synthetic oligonucleotide
  source 1..21: mol_type = other DNA
acctgcaaaatgaatatggtg

SEQ ID NO: 590 - DNA, 21 bp, synthetic construct
  misc_feature 1..21: note = Description of Artificial Sequence: Synthetic oligonucleotide
  source 1..21: mol_type = other DNA
gcaggtgaaattcctgagatg

SEQ ID NO: 591 - DNA, 21 bp, synthetic construct
  misc_feature 1..21: note = Description of Artificial Sequence: Synthetic oligonucleotide
  source 1..21: mol_type = other DNA
tggtatgttggcattaagttg

SEQ ID NO: 592 - DNA, 21 bp, synthetic construct
  misc_feature 1..21: note = Description of Artificial Sequence: Synthetic oligonucleotide
  source 1..21: mol_type = other DNA
ccaacttaatgccaacatacc

SEQ ID NO: 593 - DNA, 21 bp, synthetic construct
  misc_feature 1..21: note = Description of Artificial Sequence: Synthetic oligonucleotide
  source 1..21: mol_type = other DNA
ctttgctgggcctttttccca

SEQ ID NO: 594 - DNA, 21 bp, synthetic construct
  misc_feature 1..21: note = Description of Artificial Sequence: Synthetic oligonucleotide
  source 1..21: mol_type = other DNA
tcccatgcctgcctttactct

SEQ ID NO: 595 - DNA, 21 bp, synthetic construct
  misc_feature 1..21: note = Description of Artificial Sequence: Synthetic oligonucleotide
  source 1..21: mol_type = other DNA
cccatgcctgcctttactctg

SEQ ID NO: 596 - DNA, 21 bp, synthetic construct
  misc_feature 1..21: note = Description of Artificial Sequence: Synthetic oligonucleotide
  source 1..21: mol_type = other DNA
tttaataggatcttcttcaaa

SEQ ID NO: 597 - DNA, 21 bp, synthetic construct
  misc_feature 1..21: note = Description of Artificial Sequence: Synthetic oligonucleotide
  source 1..21: mol_type = other DNA
atttaataggatcttcttcaa

SEQ ID NO: 598 - DNA, 21 bp, synthetic construct
  misc_feature 1..21: note = Description of Artificial Sequence: Synthetic oligonucleotide
  source 1..21: mol_type = other DNA
aagaagatcctattaaataaa

SEQ ID NO: 599 - DNA, 21 bp, synthetic construct
  misc_feature 1..21: note = Description of Artificial Sequence: Synthetic oligonucleotide
  source 1..21: mol_type = other DNA
agtgaacgttcacggccaggc

SEQ ID NO: 600 - DNA, 21 bp, synthetic construct
  misc_feature 1..21: note = Description of Artificial Sequence: Synthetic oligonucleotide
  source 1..21: mol_type = other DNA
tttgagaatcaaaatcggtga

SEQ ID NO: 601 - DNA, 21 bp, synthetic construct
  misc_feature 1..21: note = Description of Artificial Sequence: Synthetic oligonucleotide
  source 1..21: mol_type = other DNA
tgacacatttgtttgagaatc

SEQ ID NO: 602 - DNA, 21 bp, synthetic construct
  misc_feature 1..21: note = Description of Artificial Sequence: Synthetic oligonucleotide
  source 1..21: mol_type = other DNA
gattctcaaacaaatgtgtca

SEQ ID NO: 603 - DNA, 21 bp, synthetic construct
  misc_feature 1..21: note = Description of Artificial Sequence: Synthetic oligonucleotide
  source 1..21: mol_type = other DNA
cacatgcaaagtcagatttgt

SEQ ID NO: 604 - DNA, 21 bp, synthetic construct
  misc_feature 1..21: note = Description of Artificial Sequence: Synthetic oligonucleotide
  source 1..21: mol_type = other DNA
gtgccttcgcaggctgtttcc

SEQ ID NO: 605 - DNA, 21 bp, synthetic construct
  misc_feature 1..21: note = Description of Artificial Sequence: Synthetic oligonucleotide
  source 1..21: mol_type = other DNA
agacatcattgaccagagctc

SEQ ID NO: 606 - DNA, 21 bp, synthetic construct
  misc_feature 1..21: note = Description of Artificial Sequence: Synthetic oligonucleotide
  source 1..21: mol_type = other DNA
ttagtaaaaagagggttttgg

SEQ ID NO: 607 - DNA, 21 bp, synthetic construct
  misc_feature 1..21: note = Description of Artificial Sequence: Synthetic oligonucleotide
  source 1..21: mol_type = other DNA
actaagaaacagtgagccttg

SEQ ID NO: 608 - DNA, 21 bp, synthetic construct
  misc_feature 1..21: note = Description of Artificial Sequence: Synthetic oligonucleotide
  source 1..21: mol_type = other DNA
tcccgtgtcattctctggact

SEQ ID NO: 609 - DNA, 21 bp, synthetic construct
  misc_feature 1..21: note = Description of Artificial Sequence: Synthetic oligonucleotide
  source 1..21: mol_type = other DNA
ttcccgtgtcattctctggac

SEQ ID NO: 610 - DNA, 21 bp, synthetic construct
  misc_feature 1..21: note = Description of Artificial Sequence: Synthetic oligonucleotide
  source 1..21: mol_type = other DNA
tccctgtctgccaaaaaatct

SEQ ID NO: 611 - DNA, 21 bp, synthetic construct
  misc_feature 1..21: note = Description of Artificial Sequence: Synthetic oligonucleotide
  source 1..21: mol_type = other DNA
aattcctccacttcaacacct

SEQ ID NO: 612 - DNA, 21 bp, synthetic construct
  misc_feature 1..21: note = Description of Artificial Sequence: Synthetic oligonucleotide
  source 1..21: mol_type = other DNA
tcaaccctgagttaaaacaca

SEQ ID NO: 613 - DNA, 21 bp, synthetic construct
  misc_feature 1..21: note = Description of Artificial Sequence: Synthetic oligonucleotide
  source 1..21: mol_type = other DNA
ctcaaccctgagttaaaacac

SEQ ID NO: 614 - DNA, 21 bp, synthetic construct
  misc_feature 1..21: note = Description of Artificial Sequence: Synthetic oligonucleotide
  source 1..21: mol_type = other DNA
tcctgaaggtagctgttttct

SEQ ID NO: 615 - DNA, 21 bp, synthetic construct
  misc_feature 1..21: note = Description of Artificial Sequence: Synthetic oligonucleotide
  source 1..21: mol_type = other DNA
gtcctgaaggtagctgttttc

SEQ ID NO: 616 - DNA, 21 bp, synthetic construct
  misc_feature 1..21: note = Description of Artificial Sequence: Synthetic oligonucleotide
  source 1..21: mol_type = other DNA
aactcagggttgagaaaacag

SEQ ID NO: 617 - DNA, 21 bp, synthetic construct
  misc_feature 1..21: note = Description of Artificial Sequence: Synthetic oligonucleotide
  source 1..21: mol_type = other DNA
actcagggttgagaaaacagc

SEQ ID NO: 618 - DNA, 21 bp, synthetic construct
  misc_feature 1..21: note = Description of Artificial Sequence: Synthetic oligonucleotide
  source 1..21: mol_type = other DNA
ctggcctggaggctatccagc

SEQ ID NO: 619 - DNA, 21 bp, synthetic construct
  misc_feature 1..21: note = Description of Artificial Sequence: Synthetic oligonucleotide
  source 1..21: mol_type = other DNA
tcccgatattcctcaggtact

SEQ ID NO: 620 - DNA, 21 bp, synthetic construct
  misc_feature 1..21: note = Description of Artificial Sequence: Synthetic oligonucleotide
  source 1..21: mol_type = other DNA
ccgatattcctcaggtactcc

SEQ ID NO: 621 - DNA, 21 bp, synthetic construct
  misc_feature 1..21: note = Description of Artificial Sequence: Synthetic oligonucleotide
  source 1..21: mol_type = other DNA
agtaagtcaacttcaatgtcg

SEQ ID NO: 622 - DNA, 21 bp, synthetic construct
  misc_feature 1..21: note = Description of Artificial Sequence: Synthetic oligonucleotide
  source 1..21: mol_type = other DNA
aattctctctccattcttcag

SEQ ID NO: 623 - DNA, 21 bp, synthetic construct
  misc_feature 1..21: note = Description of Artificial Sequence: Synthetic oligonucleotide
  source 1..21: mol_type = other DNA
caattctctctccattcttca

SEQ ID NO: 624 - DNA, 21 bp, synthetic construct
  misc_feature 1..21: note = Description of Artificial Sequence: Synthetic oligonucleotide
  source 1..21: mol_type = other DNA
cagcaaggactggtctttcta

SEQ ID NO: 625 - DNA, 21 bp, synthetic construct
  misc_feature 1..21: note = Description of Artificial Sequence: Synthetic oligonucleotide
  source 1..21: mol_type = other DNA
agtgggggtgaattcagtgta

SEQ ID NO: 626 - DNA, 21 bp, synthetic construct
  misc_feature 1..21: note = Description of Artificial Sequence: Synthetic oligonucleotide
  source 1..21: mol_type = other DNA
cagtgggggtgaattcagtgt

SEQ ID NO: 627 - DNA, 21 bp, synthetic construct
  misc_feature 1..21: note = Description of Artificial Sequence: Synthetic oligonucleotide
  source 1..21: mol_type = other DNA
ctatctcttgtactacactga

SEQ ID NO: 628 - DNA, 21 bp, synthetic construct
  misc_feature 1..21: note = Description of Artificial Sequence: Synthetic oligonucleotide
  source 1..21: mol_type = other DNA
tactacactgaattcaccccc

SEQ ID NO: 629 - DNA, 21 bp, synthetic construct
  misc_feature 1..21: note = Description of Artificial Sequence: Synthetic oligonucleotide
  source 1..21: mol_type = other DNA
ggctgtgacaaagtcacatgg

SEQ ID NO: 630 - DNA, 21 bp, synthetic construct
  misc_feature 1..21: note = Description of Artificial Sequence: Synthetic oligonucleotide
  source 1..21: mol_type = other DNA
caaaagaatgtaagacttacc

SEQ ID NO: 631 - DNA, 21 bp, synthetic construct
  misc_feature 1..21: note = Description of Artificial Sequence: Synthetic oligonucleotide
  source 1..21: mol_type = other DNA
cctccatgatgctgcttacat

SEQ ID NO: 632 - DNA, 21 bp, synthetic construct
  misc_feature 1..21: note = Description of Artificial Sequence: Synthetic oligonucleotide
  source 1..21: mol_type = other DNA
ttcatagatcgagacatgtaa

SEQ ID NO: 633 - DNA, 21 bp, synthetic construct
  misc_feature 1..21: note = Description of Artificial Sequence: Synthetic oligonucleotide
  source 1..21: mol_type = other DNA
tcatagatcgagacatgtaag

SEQ ID NO: 634 - DNA, 21 bp, synthetic construct
  misc_feature 1..21: note = Description of Artificial Sequence: Synthetic oligonucleotide
  source 1..21: mol_type = other DNA
catagatcgagacatgtaagc

SEQ ID NO: 635 - DNA, 21 bp, synthetic construct
  misc_feature 1..21: note = Description of Artificial Sequence: Synthetic oligonucleotide
  source 1..21: mol_type = other DNA
atagatcgagacatgtaagca

SEQ ID NO: 636 - DNA, 21 bp, synthetic construct
  misc_feature 1..21: note = Description of Artificial Sequence: Synthetic oligonucleotide
  source 1..21: mol_type = other DNA
ccttggggctctgacaggtag

SEQ ID NO: 637 - DNA, 21 bp, synthetic construct
  misc_feature 1..21: note = Description of Artificial Sequence: Synthetic oligonucleotide
  source 1..21: mol_type = other DNA
accttggggctctgacaggta

SEQ ID NO: 638 - DNA, 21 bp, synthetic construct
  misc_feature 1..21: note = Description of Artificial Sequence: Synthetic oligonucleotide
  source 1..21: mol_type = other DNA
ccggcctttttaccttggggc

SEQ ID NO: 639 - DNA, 21 bp, synthetic construct
  misc_feature 1..21: note = Description of Artificial Sequence: Synthetic oligonucleotide
  source 1..21: mol_type = other DNA
ctcccagaacccgacacagac

SEQ ID NO: 640 - DNA, 21 bp, synthetic construct
  misc_feature 1..21: note = Description of Artificial Sequence: Synthetic oligonucleotide
  source 1..21: mol_type = other DNA
tgggctcaggtgcttcctcac

SEQ ID NO: 641 - DNA, 21 bp, synthetic construct
  misc_feature 1..21: note = Description of Artificial Sequence: Synthetic oligonucleotide
  source 1..21: mol_type = other DNA
ctgggctcaggtgcttcctca

SEQ ID NO: 642 - DNA, 21 bp, synthetic construct
  misc_feature 1..21: note = Description of Artificial Sequence: Synthetic oligonucleotide
  source 1..21: mol_type = other DNA
cttgtctgggcagcggaactg

SEQ ID NO: 643 - DNA, 21 bp, synthetic construct
  misc_feature 1..21: note = Description of Artificial Sequence: Synthetic oligonucleotide
  source 1..21: mol_type = other DNA
ctcaaagtagagcacatagga

SEQ ID NO: 644 - DNA, 21 bp, synthetic construct
  misc_feature 1..21: note = Description of Artificial Sequence: Synthetic oligonucleotide
  source 1..21: mol_type = other DNA
tcaaagtagagcacataggac

SEQ ID NO: 645 - DNA, 21 bp, synthetic construct
  misc_feature 1..21: note = Description of Artificial Sequence: Synthetic oligonucleotide
  source 1..21: mol_type = other DNA
tgcccaacttctgctggcatc

SEQ ID NO: 646 - DNA, 21 bp, synthetic construct
  misc_feature 1..21: note = Description of Artificial Sequence: Synthetic oligonucleotide
  source 1..21: mol_type = other DNA
tgacttttctgcccaacttct

SEQ ID NO: 647 - DNA, 21 bp, synthetic construct
  misc_feature 1..21: note = Description of Artificial Sequence: Synthetic oligonucleotide
  source 1..21: mol_type = other DNA
tctgcagccttcccagaggag

SEQ ID NO: 648 - DNA, 21 bp, synthetic construct
  misc_feature 1..21: note = Description of Artificial Sequence: Synthetic oligonucleotide
  source 1..21: mol_type = other DNA
tccaggcgcatctggccggag

SEQ ID NO: 649 - DNA, 21 bp, synthetic construct
  misc_feature 1..21: note = Description of Artificial Sequence: Synthetic oligonucleotide
  source 1..21: mol_type = other DNA
tccagttcctcgttgagctgc

SEQ ID NO: 650 - DNA, 21 bp, synthetic construct
  misc_feature 1..21: note = Description of Artificial Sequence: Synthetic oligonucleotide
  source 1..21: mol_type = other DNA
ccagagcccatggggcagagt

SEQ ID NO: 651 - DNA, 21 bp, synthetic construct
  misc_feature 1..21: note = Description of Artificial Sequence: Synthetic oligonucleotide
  source 1..21: mol_type = other DNA
tccccaccatctccactctgc

SEQ ID NO: 652 - DNA, 21 bp, synthetic construct
  misc_feature 1..21: note = Description of Artificial Sequence: Synthetic oligonucleotide
  source 1..21: mol_type = other DNA
ctcgggaggtcagggcaggtt

SEQ ID NO: 653 - DNA, 21 bp, synthetic construct
  misc_feature 1..21: note = Description of Artificial Sequence: Synthetic oligonucleotide
  source 1..21: mol_type = other DNA
gaagcttgttggagacctctc

SEQ ID NO: 654 - DNA, 21 bp, synthetic construct
  misc_feature 1..21: note = Description of Artificial Sequence: Synthetic oligonucleotide
  source 1..21: mol_type = other DNA
ggaagcttgttggagacctct

SEQ ID NO: 655 - DNA, 21 bp, synthetic construct
  misc_feature 1..21: note = Description of Artificial Sequence: Synthetic oligonucleotide
  source 1..21: mol_type = other DNA
cagagccggtggagcagttct

SEQ ID NO: 656 - DNA, 21 bp, synthetic construct
  misc_feature 1..21: note = Description of Artificial Sequence: Synthetic oligonucleotide
  source 1..21: mol_type = other DNA
cccagcacagcaatcactcgt

SEQ ID NO: 657 - DNA, 21 bp, synthetic construct
  misc_feature 1..21: note = Description of Artificial Sequence: Synthetic oligonucleotide
  source 1..21: mol_type = other DNA
tcttctctgtcccctgccatt

SEQ ID NO: 658 - DNA, 21 bp, synthetic construct
  misc_feature 1..21: note = Description of Artificial Sequence: Synthetic oligonucleotide
  source 1..21: mol_type = other DNA
agccacatcttgaagagacct

SEQ ID NO: 659 - DNA, 21 bp, synthetic construct
  misc_feature 1..21: note = Description of Artificial Sequence: Synthetic oligonucleotide
  source 1..21: mol_type = other DNA
ccagaagaagctgctccgagg

SEQ ID NO: 660 - DNA, 21 bp, synthetic construct
  misc_feature 1..21: note = Description of Artificial Sequence: Synthetic oligonucleotide
  source 1..21: mol_type = other DNA
cagaagaagctgctccgaggt

SEQ ID NO: 661 - DNA, 21 bp, synthetic construct
  misc_feature 1..21: note = Description of Artificial Sequence: Synthetic oligonucleotide
  source 1..21: mol_type = other DNA
agctgtccggcttctccatgg

SEQ ID NO: 662 - DNA, 21 bp, synthetic construct
  misc_feature 1..21: note = Description of Artificial Sequence: Synthetic oligonucleotide
  source 1..21: mol_type = other DNA
agagctcagggatgacagagc

SEQ ID NO: 663 - DNA, 21 bp, synthetic construct
  misc_feature 1..21: note = Description of Artificial Sequence: Synthetic oligonucleotide
  source 1..21: mol_type = other DNA
tgccgggcagtgtgccagctc

SEQ ID NO: 664 - DNA, 21 bp, synthetic construct
  misc_feature 1..21: note = Description of Artificial Sequence: Synthetic oligonucleotide
  source 1..21: mol_type = other DNA
atgtctgcggcccagctccca

SEQ ID NO: 665 - DNA, 21 bp, synthetic construct
  misc_feature 1..21: note = Description of Artificial Sequence: Synthetic oligonucleotide
  source 1..21: mol_type = other DNA
gccatcgcccaggtcctcacg

SEQ ID NO: 666 - DNA, 21 bp, synthetic construct
  misc_feature 1..21: note = Description of Artificial Sequence: Synthetic oligonucleotide
  source 1..21: mol_type = other DNA
gccactcagagccagccacag

SEQ ID NO: 667 - DNA, 21 bp, synthetic construct
  misc_feature 1..21: note = Description of Artificial Sequence: Synthetic oligonucleotide
  source 1..21: mol_type = other DNA
tggctgggctgatcttccagc

SEQ ID NO: 668 - DNA, 21 bp, synthetic construct
  misc_feature 1..21: note = Description of Artificial Sequence: Synthetic oligonucleotide
  source 1..21: mol_type = other DNA
gcagcacgtggtacaggagct

SEQ ID NO: 669 - DNA, 21 bp, synthetic construct
  misc_feature 1..21: note = Description of Artificial Sequence: Synthetic oligonucleotide
  source 1..21: mol_type = other DNA
ctgggcacccgcctcacgcct

SEQ ID NO: 670 - DNA, 21 bp, synthetic construct
  misc_feature 1..21: note = Description of Artificial Sequence: Synthetic oligonucleotide
  source 1..21: mol_type = other DNA
tgggcacccgcctcacgcctc

SEQ ID NO: 671 - DNA, 21 bp, synthetic construct
  misc_feature 1..21: note = Description of Artificial Sequence: Synthetic oligonucleotide
  source 1..21: mol_type = other DNA
cccctctggattggggagcct

SEQ ID NO: 672 - DNA, 21 bp, synthetic construct
  misc_feature 1..21: note = Description of Artificial Sequence: Synthetic oligonucleotide
  source 1..21: mol_type = other DNA
aaaggctcgatggtgaacttc

SEQ ID NO: 673 - DNA, 21 bp, synthetic construct
  misc_feature 1..21: note = Description of Artificial Sequence: Synthetic oligonucleotide
  source 1..21: mol_type = other DNA
ccaggtcttccacatccttca

SEQ ID NO: 674 - DNA, 21 bp, synthetic construct
  misc_feature 1..21: note = Description of Artificial Sequence: Synthetic oligonucleotide
  source 1..21: mol_type = other DNA
aaagccaagtccctgaaggat

SEQ ID NO: 675 - DNA, 21 bp, synthetic construct
  misc_feature 1..21: note = Description of Artificial Sequence: Synthetic oligonucleotide
  source 1..21: mol_type = other DNA
ggtcccgaacagcagggagct

SEQ ID NO: 676 - DNA, 21 bp, synthetic construct
  misc_feature 1..21: note = Description of Artificial Sequence: Synthetic oligonucleotide
  source 1..21: mol_type = other DNA
tttaggtcccgaacagcaggg

SEQ ID NO: 677 - DNA, 21 bp, synthetic construct
  misc_feature 1..21: note = Description of Artificial Sequence: Synthetic oligonucleotide
  source 1..21: mol_type = other DNA
cttacgcaaactccagtttct

SEQ ID NO: 678 - DNA, 21 bp, synthetic construct
  misc_feature 1..21: note = Description of Artificial Sequence: Synthetic oligonucleotide
  source 1..21: mol_type = other DNA
cctcctaggctgggccctgtc

SEQ ID NO: 679 - DNA, 21 bp, synthetic construct
  misc_feature 1..21: note = Description of Artificial Sequence: Synthetic oligonucleotide
  source 1..21: mol_type = other DNA
gggaaagcctgggggcctgag

SEQ ID NO: 680 - DNA, 21 bp, synthetic construct
  misc_feature 1..21: note = Description of Artificial Sequence: Synthetic oligonucleotide
  source 1..21: mol_type = other DNA
cccaaactggtgcggatcctc

SEQ ID NO: 681 - DNA, 21 bp, synthetic construct
  misc_feature 1..21: note = Description of Artificial Sequence: Synthetic oligonucleotide
  source 1..21: mol_type = other DNA
ctccctgcagcatctggagtg

SEQ ID NO: 682 - DNA, 21 bp, synthetic construct
  misc_feature 1..21: note = Description of Artificial Sequence: Synthetic oligonucleotide
  source 1..21: mol_type = other DNA
caaggacttcagctgggggaa

SEQ ID NO: 683 - DNA, 21 bp, synthetic construct
  misc_feature 1..21: note = Description of Artificial Sequence: Synthetic oligonucleotide
  source 1..21: mol_type = other DNA
taggcacccaggtcagtgatg

SEQ ID NO: 684 - DNA, 21 bp, synthetic construct
  misc_feature 1..21: note = Description of Artificial Sequence: Synthetic oligonucleotide
  source 1..21: mol_type = other DNA
cgacagcttgtacaataactg

SEQ ID NO: 685 - DNA, 21 bp, synthetic construct
  misc_feature 1..21: note = Description of Artificial Sequence: Synthetic oligonucleotide
  source 1..21: mol_type = other DNA
tcttgccagcgtccagtacaa

SEQ ID NO: 686 - DNA, 21 bp, synthetic construct
  misc_feature 1..21: note = Description of Artificial Sequence: Synthetic oligonucleotide
  source 1..21: mol_type = other DNA
cccggcctttttaccttgggg

SEQ ID NO: 687 - DNA, 21 bp, synthetic construct
  misc_feature 1..21: note = Description of Artificial Sequence: Synthetic oligonucleotide
  source 1..21: mol_type = other DNA
cctcccaggcagctcacagtg

SEQ ID NO: 688 - DNA, 21 bp, synthetic construct
  misc_feature 1..21: note = Description of Artificial Sequence: Synthetic oligonucleotide
  source 1..21: mol_type = other DNA
tccagccaggtccatctggtc

SEQ ID NO: 689 - DNA, 21 bp, synthetic construct
  misc_feature 1..21: note = Description of Artificial Sequence: Synthetic oligonucleotide
  source 1..21: mol_type = other DNA
ttctccagccaggtccatctg

SEQ ID NO: 690 - DNA, 21 bp, synthetic construct
  misc_feature 1..21: note = Description of Artificial Sequence: Synthetic oligonucleotide
  source 1..21: mol_type = other DNA
atcaccttccatgtcacacaa

SEQ ID NO: 691 - DNA, 21 bp, synthetic construct
  misc_feature 1..21: note = Description of Artificial Sequence: Synthetic oligonucleotide
  source 1..21: mol_type = other DNA
tctgggctcaggtgcttcctc

SEQ ID NO: 692 - DNA, 21 bp, synthetic construct
  misc_feature 1..21: note = Description of Artificial Sequence: Synthetic oligonucleotide
  source 1..21: mol_type = other DNA
tgccaatatcggtgaggaagc

SEQ ID NO: 693 - DNA, 21 bp, synthetic construct
  misc_feature 1..21: note = Description of Artificial Sequence: Synthetic oligonucleotide
  source 1..21: mol_type = other DNA
caggactcccagctggagggc

SEQ ID NO: 694 - DNA, 21 bp, synthetic construct
  misc_feature 1..21: note = Description of Artificial Sequence: Synthetic oligonucleotide
  source 1..21: mol_type = other DNA
tctgacttttctgcccaactt

SEQ ID NO: 695 - DNA, 21 bp, synthetic construct
  misc_feature 1..21: note = Description of Artificial Sequence: Synthetic oligonucleotide
  source 1..21: mol_type = other DNA
cagtgcctttctccagttcct

SEQ ID NO: 696 - DNA, 21 bp, synthetic construct
  misc_feature 1..21: note = Description of Artificial Sequence: Synthetic oligonucleotide
  source 1..21: mol_type = other DNA
gctggcctggggcacctcacc

SEQ ID NO: 697 - DNA, 21 bp, synthetic construct
  misc_feature 1..21: note = Description of Artificial Sequence: Synthetic oligonucleotide
  source 1..21: mol_type = other DNA
gctccatcagccactgacctg

SEQ ID NO: 698 - DNA, 21 bp, synthetic construct
  misc_feature 1..21: note = Description of Artificial Sequence: Synthetic oligonucleotide
  source 1..21: mol_type = other DNA
cctgtcatgtttgctcgggag

SEQ ID NO: 699 - DNA, 21 bp, synthetic construct
  misc_feature 1..21: note = Description of Artificial Sequence: Synthetic oligonucleotide
  source 1..21: mol_type = other DNA
tccatctccagagcacaagac

SEQ ID NO: 700 - DNA, 21 bp, synthetic construct
  misc_feature 1..21: note = Description of Artificial Sequence: Synthetic oligonucleotide
  source 1..21: mol_type = other DNA
ttggagacctctccagctgcc

SEQ ID NO: 701 - DNA, 21 bp, synthetic construct
  misc_feature 1..21: note = Description of Artificial Sequence: Synthetic oligonucleotide
  source 1..21: mol_type = other DNA
gcagagccggtggagcagttc

SEQ ID NO: 702 - DNA, 21 bp, synthetic construct
  misc_feature 1..21: note = Description of Artificial Sequence: Synthetic oligonucleotide
  source 1..21: mol_type = other DNA
ctgctgctcctctccagcctg

SEQ ID NO: 703 - DNA, 21 bp, synthetic construct
  misc_feature 1..21: note = Description of Artificial Sequence: Synthetic oligonucleotide
  source 1..21: mol_type = other DNA
gcagccaacagcacctcagcc

SEQ ID NO: 704 - DNA, 21 bp, synthetic construct
  misc_feature 1..21: note = Description of Artificial Sequence: Synthetic oligonucleotide
  source 1..21: mol_type = other DNA
gcccagcacagcaatcactcg

SEQ ID NO: 705 - DNA, 21 bp, synthetic construct
  misc_feature 1..21: note = Description of Artificial Sequence: Synthetic oligonucleotide
  source 1..21: mol_type = other DNA
agccatcagaagcagagatct

SEQ ID NO: 706 - DNA, 21 bp, synthetic construct
  misc_feature 1..21: note = Description of Artificial Sequence: Synthetic oligonucleotide
  source 1..21: mol_type = other DNA
cgctgtcaagtccagttctac

SEQ ID NO: 707 - DNA, 21 bp, synthetic construct
  misc_feature 1..21: note = Description of Artificial Sequence: Synthetic oligonucleotide
  source 1..21: mol_type = other DNA
ccctgttttctttcagactgt

SEQ ID NO: 708 - DNA, 21 bp, synthetic construct
  misc_feature 1..21: note = Description of Artificial Sequence: Synthetic oligonucleotide
  source 1..21: mol_type = other DNA
ctttcagactgtggcttcacc

SEQ ID NO: 709 - DNA, 21 bp, synthetic construct
  misc_feature 1..21: note = Description of Artificial Sequence: Synthetic oligonucleotide
  source 1..21: mol_type = other DNA
tttcagactgtggcttcacct

SEQ ID NO: 710 - DNA, 21 bp, synthetic construct
  misc_feature 1..21: note = Description of Artificial Sequence: Synthetic oligonucleotide
  source 1..21: mol_type = other DNA
cagactgtggcttcacctccg

SEQ ID NO: 711 - DNA, 21 bp, synthetic construct
  misc_feature 1..21: note = Description of Artificial Sequence: Synthetic oligonucleotide
  source 1..21: mol_type = other DNA
agactgtggcttcacctccgg

SEQ ID NO: 712 - DNA, 21 bp, synthetic construct
  misc_feature 1..21: note = Description of Artificial Sequence: Synthetic oligonucleotide
  source 1..21: mol_type = other DNA
ccggaggtgaagccacagtct

SEQ ID NO: 713 - DNA, 21 bp, synthetic construct
  misc_feature 1..21: note = Description of Artificial Sequence: Synthetic oligonucleotide
  source 1..21: mol_type = other DNA
tcaacagagtcttaccagcaa

SEQ ID NO: 714 - DNA, 21 bp, synthetic construct
  misc_feature 1..21: note = Description of Artificial Sequence: Synthetic oligonucleotide
  source 1..21: mol_type = other DNA
ccagcaaggggtcctgtctgc

SEQ ID NO: 715 - DNA, 21 bp, synthetic construct
  misc_feature 1..21: note = Description of Artificial Sequence: Synthetic oligonucleotide
  source 1..21: mol_type = other DNA
ctagggaaggccaccttgtat

SEQ ID NO: 716 - DNA, 21 bp, synthetic construct
  misc_feature 1..21: note = Description of Artificial Sequence: Synthetic oligonucleotide
  source 1..21: mol_type = other DNA
tatgccgtgctggtcagtgcc

SEQ ID NO: 717 - DNA, 21 bp, synthetic construct
  misc_feature 1..21: note = Description of Artificial Sequence: Synthetic oligonucleotide
  source 1..21: mol_type = other DNA
ccatggccatcagcacgaggg

SEQ ID NO: 718 - DNA, 21 bp, synthetic construct
  misc_feature 1..21: note = Description of Artificial Sequence: Synthetic oligonucleotide
  source 1..21: mol_type = other DNA
cctagcaagatctcatagagg

SEQ ID NO: 719 - DNA, 21 bp, synthetic construct
  misc_feature 1..21: note = Description of Artificial Sequence: Synthetic oligonucleotide
  source 1..21: mol_type = other DNA
cacaggtcaagagaaaggatt

SEQ ID NO: 720 - DNA, 21 bp, synthetic construct
  misc_feature 1..21: note = Description of Artificial Sequence: Synthetic oligonucleotide
  source 1..21: mol_type = other DNA
gagctagcctctggaatcctt

SEQ ID NO: 721 - DNA, 21 bp, synthetic construct
  misc_feature 1..21: note = Description of Artificial Sequence: Synthetic oligonucleotide
  source 1..21: mol_type = other DNA
tagtaccgctcctggaaggtt

SEQ ID NO: 722 - DNA, 21 bp, synthetic construct
  misc_feature 1..21: note = Description of Artificial Sequence: Synthetic oligonucleotide
  source 1..21: mol_type = other DNA
atcttgtagtaccgctcctgg

SEQ ID NO: 723 - DNA, 21 bp, synthetic construct
  misc_feature 1..21: note = Description of Artificial Sequence: Synthetic oligonucleotide
  source 1..21: mol_type = other DNA
cttcatcttgtagtaccgctc

SEQ ID NO: 724 - DNA, 21 bp, synthetic construct
  misc_feature 1..21: note = Description of Artificial Sequence: Synthetic oligonucleotide
  source 1..21: mol_type = other DNA
tgtgttgcagttcagcaggag

SEQ ID NO: 725 - DNA, 21 bp, synthetic construct
  misc_feature 1..21: note = Description of Artificial Sequence: Synthetic oligonucleotide
  source 1..21: mol_type = other DNA
cgttatagagctggttctggc

SEQ ID NO: 726 - DNA, 21 bp, synthetic construct
  misc_feature 1..21: note = Description of Artificial Sequence: Synthetic oligonucleotide
  source 1..21: mol_type = other DNA
cggagggtctacggcgaggct

SEQ ID NO: 727 - DNA, 21 bp, synthetic construct
  misc_feature 1..21: note = Description of Artificial Sequence: Synthetic oligonucleotide
  source 1..21: mol_type = other DNA
ttatctgttataggagctcaa

SEQ ID NO: 728 - DNA, 21 bp, synthetic construct
  misc_feature 1..21: note = Description of Artificial Sequence: Synthetic oligonucleotide
  source 1..21: mol_type = other DNA
tctgttataggagctcaatct

SEQ ID NO: 729 - DNA, 21 bp, synthetic construct
  misc_feature 1..21: note = Description of Artificial Sequence: Synthetic oligonucleotide
  source 1..21: mol_type = other DNA
tccaaaacatcgtactcctct

SEQ ID NO: 730 - DNA, 21 bp, synthetic construct
  misc_feature 1..21: note = Description of Artificial Sequence: Synthetic oligonucleotide
  source 1..21: mol_type = other DNA
cccccatctcagggtcccggc

SEQ ID NO: 731 - DNA, 21 bp, synthetic construct
  misc_feature 1..21: note = Description of Artificial Sequence: Synthetic oligonucleotide
  source 1..21: mol_type = other DNA
gacaagagacgtggccgggac

SEQ ID NO: 732 - DNA, 21 bp, synthetic construct
  misc_feature 1..21: note = Description of Artificial Sequence: Synthetic oligonucleotide
  source 1..21: mol_type = other DNA
tctccctctaacgtcttcccg

SEQ ID NO: 733 - DNA, 21 bp, synthetic construct
  misc_feature 1..21: note = Description of Artificial Sequence: Synthetic oligonucleotide
  source 1..21: mol_type = other DNA
ctgagggttcttccttctctg

SEQ ID NO: 734 - DNA, 21 bp, synthetic construct
  misc_feature 1..21: note = Description of Artificial Sequence: Synthetic oligonucleotide
  source 1..21: mol_type = other DNA
ccgttgtctttcctagcagag

SEQ ID NO: 735 - DNA, 21 bp, synthetic construct
  misc_feature 1..21: note = Description of Artificial Sequence: Synthetic oligonucleotide
  source 1..21: mol_type = other DNA
ctagcagagaaggaagaaccc

SEQ ID NO: 736 - DNA, 21 bp, synthetic construct
  misc_feature 1..21: note = Description of Artificial Sequence: Synthetic oligonucleotide
  source 1..21: mol_type = other DNA
tgcagttcctgcagaagaggg

SEQ ID NO: 737 - DNA, 21 bp, synthetic construct
  misc_feature 1..21: note = Description of Artificial Sequence: Synthetic oligonucleotide
  source 1..21: mol_type = other DNA
tgcaggaactgcagaaagata

SEQ ID NO: 738 - DNA, 21 bp, synthetic construct
  misc_feature 1..21: note = Description of Artificial Sequence: Synthetic oligonucleotide
  source 1..21: mol_type = other DNA
atcccaatctcactgtaggcc

SEQ ID NO: 739 - DNA, 21 bp, synthetic construct
  misc_feature 1..21: note = Description of Artificial Sequence: Synthetic oligonucleotide
  source 1..21: mol_type = other DNA
catcccaatctcactgtaggc

SEQ ID NO: 740 - DNA, 21 bp, synthetic construct
  misc_feature 1..21: note = Description of Artificial Sequence: Synthetic oligonucleotide
  source 1..21: mol_type = other DNA
ctcatttcactcccaaacaac

SEQ ID NO: 741 - DNA, 21 bp, synthetic construct
  misc_feature 1..21: note = Description of Artificial Sequence: Synthetic oligonucleotide
  source 1..21: mol_type = other DNA
tcatttcactcccaaacaacc

SEQ ID NO: 742 - DNA, 21 bp, synthetic construct
  misc_feature 1..21: note = Description of Artificial Sequence: Synthetic oligonucleotide
  source 1..21: mol_type = other DNA
actcccaaacaaccagcgccg

SEQ ID NO: 743 - DNA, 21 bp, synthetic construct
  misc_feature 1..21: note = Description of Artificial Sequence: Synthetic oligonucleotide
  source 1..21: mol_type = other DNA
ttttctgatttgctttcacgc

SEQ ID NO: 744 - DNA, 21 bp, synthetic construct
  misc_feature 1..21: note = Description of Artificial Sequence: Synthetic oligonucleotide
  source 1..21: mol_type = other DNA
tgatttgctttcacgccaggg

SEQ ID NO: 745 - DNA, 21 bp, synthetic construct
  misc_feature 1..21: note = Description of Artificial Sequence: Synthetic oligonucleotide
  source 1..21: mol_type = other DNA
ctttcacgccagggtctcagt

SEQ ID NO: 746 - DNA, 21 bp, synthetic construct
  misc_feature 1..21: note = Description of Artificial Sequence: Synthetic oligonucleotide
  source 1..21: mol_type = other DNA
acgccagggtctcagtacagc

SEQ ID NO: 747 - DNA, 21 bp, synthetic construct
  misc_feature 1..21: note = Description of Artificial Sequence: Synthetic oligonucleotide
  source 1..21: mol_type = other DNA
ctttccaggggagatggatcc

SEQ ID NO: 748 - DNA, 21 bp, synthetic construct
  misc_feature 1..21: note = Description of Artificial Sequence: Synthetic oligonucleotide
  source 1..21: mol_type = other DNA
ccaggggagatggatcctatc

SEQ ID NO: 749 - DNA, 21 bp, synthetic construct
  misc_feature 1..21: note = Description of Artificial Sequence: Synthetic oligonucleotide
  source 1..21: mol_type = other DNA
caggggagatggatcctatct

SEQ ID NO: 750 - DNA, 21 bp, synthetic construct
  misc_feature 1..21: note = Description of Artificial Sequence: Synthetic oligonucleotide
  source 1..21: mol_type = other DNA
ctaaccatcagcattttgagt

SEQ ID NO: 751 - DNA, 21 bp, synthetic construct
  misc_feature 1..21: note = Description of Artificial Sequence: Synthetic oligonucleotide
  source 1..21: mol_type = other DNA
gagttttttctctgtcgctct

SEQ ID NO: 752 - DNA, 21 bp, synthetic construct
  misc_feature 1..21: note = Description of Artificial Sequence: Synthetic oligonucleotide
  source 1..21: mol_type = other DNA
agttttttctctgtcgctctg

SEQ ID NO: 753 - DNA, 21 bp, synthetic construct
  misc_feature 1..21: note = Description of Artificial Sequence: Synthetic oligonucleotide
  source 1..21: mol_type = other DNA
tctgtcgctctgttggtcatc

SEQ ID NO: 754 - DNA, 21 bp, synthetic construct
  misc_feature 1..21: note = Description of Artificial Sequence: Synthetic oligonucleotide
  source 1..21: mol_type = other DNA
cataacacacaggccaagatg

SEQ ID NO: 755 - DNA, 21 bp, synthetic construct
  misc_feature 1..21: note = Description of Artificial Sequence: Synthetic oligonucleotide
  source 1..21: mol_type = other DNA
atgtcctttcacccatcaacc

SEQ ID NO: 756 - DNA, 21 bp, synthetic construct
  misc_feature 1..21: note = Description of Artificial Sequence: Synthetic oligonucleotide
  source 1..21: mol_type = other DNA
cacccatcaacccgtagggat

SEQ ID NO: 757 - DNA, 21 bp, synthetic construct
  misc_feature 1..21: note = Description of Artificial Sequence: Synthetic oligonucleotide
  source 1..21: mol_type = other DNA
acccatcaacccgtagggatg

SEQ ID NO: 758 - DNA, 21 bp, synthetic construct
  misc_feature 1..21: note = Description of Artificial Sequence: Synthetic oligonucleotide
  source 1..21: mol_type = other DNA
ctcatacaccacgaagcgcag

SEQ ID NO: 759 - DNA, 21 bp, synthetic construct
  misc_feature 1..21: note = Description of Artificial Sequence: Synthetic oligonucleotide
  source 1..21: mol_type = other DNA
cctttctgcgcttcgtggtgt

SEQ ID NO: 760 - DNA, 21 bp, synthetic construct
  misc_feature 1..21: note = Description of Artificial Sequence: Synthetic oligonucleotide
  source 1..21: mol_type = other DNA
ctgcgcttcgtggtgtatgag

SEQ ID NO: 761 - DNA, 21 bp, synthetic construct
  misc_feature 1..21: note = Description of Artificial Sequence: Synthetic oligonucleotide
  source 1..21: mol_type = other DNA
tgcgcttcgtggtgtatgagg

SEQ ID NO: 762 - DNA, 21 bp, synthetic construct
  misc_feature 1..21: note = Description of Artificial Sequence: Synthetic oligonucleotide
  source 1..21: mol_type = other DNA
gtggtgtatgaggaagacatg

SEQ ID NO: 763 - DNA, 21 bp, synthetic construct
  misc_feature 1..21: note = Description of Artificial Sequence: Synthetic oligonucleotide
  source 1..21: mol_type = other DNA
gtcctttccacaagatatata

SEQ ID NO: 764 - DNA, 21 bp, synthetic construct
  misc_feature 1..21: note = Description of Artificial Sequence: Synthetic oligonucleotide
  source 1..21: mol_type = other DNA
gatttcttggctttatatatc

SEQ ID NO: 765 - DNA, 21 bp, synthetic construct
  misc_feature 1..21: note = Description of Artificial Sequence: Synthetic oligonucleotide
  source 1..21: mol_type = other DNA
ttggctttatatatcttgtgg

SEQ ID NO: 766 - DNA, 21 bp, synthetic construct
  misc_feature 1..21: note = Description of Artificial Sequence: Synthetic oligonucleotide
  source 1..21: mol_type = other DNA
gctttatatatcttgtggaaa

SEQ ID NO: 767 - DNA, 21 bp, synthetic construct
  misc_feature 1..21: note = Description of Artificial Sequence: Synthetic oligonucleotide
  source 1..21: mol_type = other DNA
atatatcttgtggaaaggacg

SEQ ID NO: 768 - DNA, 21 bp, synthetic construct
  misc_feature 1..21: note = Description of Artificial Sequence: Synthetic oligonucleotide
  source 1..21: mol_type = other DNA
tatatcttgtggaaaggacga

SEQ ID NO: 769 - DNA, 21 bp, synthetic construct
  misc_feature 1..21: note = Description of Artificial Sequence: Synthetic oligonucleotide
  source 1..21: mol_type = other DNA
tggaaaggacgaaacaccgtg

SEQ ID NO: 770 - DNA, 21 bp, synthetic construct
  misc_feature 1..21: note = Description of Artificial Sequence: Synthetic oligonucleotide
  source 1..21: mol_type = other DNA
ttgcagaagcgggcccaggat

SEQ ID NO: 771 - DNA, 21 bp, synthetic construct
  misc_feature 1..21: note = Description of Artificial Sequence: Synthetic oligonucleotide
  source 1..21: mol_type = other DNA
ttgcagaagcgggcccaggat

SEQ ID NO: 772 - DNA, 21 bp, synthetic construct
  misc_feature 1..21: note = Description of Artificial Sequence: Synthetic oligonucleotide
  source 1..21: mol_type = other DNA
tatgctgaacacctgatgccg

SEQ ID NO: 773 - DNA, 21 bp, synthetic construct
  misc_feature 1..21: note = Description of Artificial Sequence: Synthetic oligonucleotide
  source 1..21: mol_type = other DNA
ccagggtcggccggtgcccgt

SEQ ID NO: 774 - DNA, 21 bp, synthetic construct
  misc_feature 1..21: note = Description of Artificial Sequence: Synthetic oligonucleotide
  source 1..21: mol_type = other DNA
gccggtggagccgccgccgga

SEQ ID NO: 775 - DNA, 21 bp, synthetic construct
  misc_feature 1..21: note = Description of Artificial Sequence: Synthetic oligonucleotide
  source 1..21: mol_type = other DNA
tgggcaagggcggctttgcca

SEQ ID NO: 776 - DNA, 21 bp, synthetic construct
  misc_feature 1..21: note = Description of Artificial Sequence: Synthetic oligonucleotide
  source 1..21: mol_type = other DNA
gggcaagggcggctttgccaa

SEQ ID NO: 777 - DNA, 21 bp, synthetic construct
  misc_feature 1..21: note = Description of Artificial Sequence: Synthetic oligonucleotide
  source 1..21: mol_type = other DNA
ggcaagggcggctttgccaag

SEQ ID NO: 778 - DNA, 21 bp, synthetic construct
  misc_feature 1..21: note = Description of Artificial Sequence: Synthetic oligonucleotide
  source 1..21: mol_type = other DNA
ccaagtgcttcgagatctcgg

SEQ ID NO: 779 - DNA, 21 bp, synthetic construct
  misc_feature 1..21: note = Description of Artificial Sequence: Synthetic oligonucleotide
  source 1..21: mol_type = other DNA
catggacatcttctccctctg

SEQ ID NO: 780 - DNA, 21 bp, synthetic construct
  misc_feature 1..21: note = Description of Artificial Sequence: Synthetic oligonucleotide
  source 1..21: mol_type = other DNA
tcgaggacaacgacttcgtgt

SEQ ID NO: 781 - DNA, 21 bp, synthetic construct
  misc_feature 1..21: note = Description of Artificial Sequence: Synthetic oligonucleotide
  source 1..21: mol_type = other DNA
cgaggacaacgacttcgtgtt

SEQ ID NO: 782 - DNA, 21 bp, synthetic construct
  misc_feature 1..21: note = Description of Artificial Sequence: Synthetic oligonucleotide
  source 1..21: mol_type = other DNA
gaggacaacgacttcgtgttc

SEQ ID NO: 783 - DNA, 21 bp, synthetic construct
  misc_feature 1..21: note = Description of Artificial Sequence: Synthetic oligonucleotide
  source 1..21: mol_type = other DNA
cagttaaaaaccaccacaaca

SEQ ID NO: 784 - DNA, 21 bp, synthetic construct
  misc_feature 1..21: note = Description of Artificial Sequence: Synthetic oligonucleotide
  source 1..21: mol_type = other DNA
gctgaatggccgggaggagga

SEQ ID NO: 785 - DNA, 21 bp, synthetic construct
  misc_feature 1..21: note = Description of Artificial Sequence: Synthetic oligonucleotide
  source 1..21: mol_type = other DNA
tggagtggcagatgggagagc

SEQ ID NO: 786 - DNA, 21 bp, synthetic construct
  misc_feature 1..21: note = Description of Artificial Sequence: Synthetic oligonucleotide
  source 1..21: mol_type = other DNA
aaccatgagggaaatcgtgca

SEQ ID NO: 787 - DNA, 21 bp, synthetic construct
  misc_feature 1..21: note = Description of Artificial Sequence: Synthetic oligonucleotide
  source 1..21: mol_type = other DNA
accatgagggaaatcgtgcac

SEQ ID NO: 788 - DNA, 21 bp, synthetic construct
  misc_feature 1..21: note = Description of Artificial Sequence: Synthetic oligonucleotide
  source 1..21: mol_type = other DNA
ttctctgtaggtggcaaatat

SEQ ID NO: 789 - protein, 1364 aa, synthetic construct
  REGION 1..1364: note = Description of Artificial Sequence: Synthetic polypeptide
MGHHHHHHSSGLVPRGSGTMAAFDKFIHQYQVSKTLRFALIPQGKTLENTKNNVLQEDDERQKNYEKVKPILDRIYKVFAEESLKDCSVDWNDLNACLDAYQKNPSADKRQKVKAAQDALRDEIAGYFTGKQYANGKNKNAVKEKEQAELYKDIFSKKIFDGTVTNNKLPQVNLSAEETELLGCFDKFTTYFVGFYQNRENVFSGEDIATAIPHRIVQDNFPKFRENCRIYQDLIKNEPALKPLLQQAAAAVMAQNPKGIYQPRKSLDDIFVIPFYNHLLLQDDIDYFNQILGGISGAAGQKKIQGLNETINLFMQQHPQEADKLKKKKIRHRFIPLYKQILSDRTSFSFIPEAFSNSQEALDGIETFKKSLKKNDTFGALERLIQNLASLDLKYVYLSNKKVNEISQALYGEWHCIQDVLKQDFSLESLIQINPQNSSNGFLATLTDEGKKRISQCRNVLGNPLPVKLADDQDKAQVKNQLDTLLAAVHYLEWFKADPDLETDPNFTVPFEKIWEELVPLLSLYSKVRNFVTKKPYSTAKFKLNFANPTLADGWDIHKESDNGALLFEKGGLYYLGIMNPKDKPNFKSYQGAEPYYQKMVYRFFPDCSKTIPKCSTQRKDVKKYFEDHPQATSYQIHDSKKEKFRQDFFEIPREIYELNNTTYGTGKSKYKKFQTQYYQKTQDKSGYQKALRKWIDFSKKFLQTYVSTSIFDFKGLRPSKDYQDLGEFYKDVNSRCYRVTFEKIRVQDIHEAVKNGQLYLFQLYNKDFSPKSHGLPNLHTLYWKAVFDPENLKDPIVKLNGQAELFYRPKSNMQIIQHKTGEEIVNKKLKDGTPVPDDIYREISAYVQGKCQGNLSPEAEKWLPSVTIKKAAHDITKDRRFTEDKFFFHVPITLNYQSSGKPTAFNSQVNDFLTEHPETNIIGIDRGERNLIYAVVITPDGKILEQKSFNVIHDFDYHESLSQREKQRVAARQAWTAIGRIKDLKEGYLSLVVHEIAQMMIKYQAVVVLENLNTGFKRVRGGISEKAVYQQFEKMLIEKLNFLVFKDRAINQEGGVLKAYQLTDSFTSFAKLGNQSGFLFYIPSAYTSKIDPGTGFVDPFIWSHVTASEENRNEFLKGFDSLKYDAQSSAFVLHFKMKSNKQFQKNNVEGFMPEWDICFEKNEEKISLQGSKYTAGKRIIFDSKKKQYMECFPQNELMKALQDVGITWNTGNDIWQDVLKQASTDTGFRHRMINLIRSVLQMRSSNGATGEDYINSPVMDLDGRFFDTRAGIRDLPLDADANGAYHIALKGRMVLERIRSQKNTAIKNTDWLYAIQEERNGAPKRPAATKKAGQAKKKKASGSGAGSPKKKRKVEDPKKKRKV

SEQ ID NO: 790 - DNA, 4098 bp, synthetic construct
  misc_feature 1..4098: note = Description of Artificial Sequence: Synthetic polynucleotide
  source 1..4098: mol_type = other DNA
atgggccaccatcatcatcatcatagcagcggcctggtgccgcgcggcagcggtaccatggcggcgttcgataagttcatccatcaatatcaagtaagcaaaaccctccgttttgcacttattccgcaggggaaaaccttggagaatacaaaaaataacgtactccaggaagatgatgagcgtcagaaaaattacgaaaaagtcaaacctatccttgatcgtatttataaggtattcgctgaggaaagcctgaaagattgcagcgttgactggaatgacctcaatgcatgtctggatgcttaccaaaaaaatcctagcgcggataagcgtcagaaggtgaaagccgcgcaggacgcgttgcgggacgaaattgccggttattttacagggaaacaatacgcgaacgggaagaacaaaaatgccgttaaggagaaagagcaggcagaattgtataaggatatctttagcaaaaagatctttgatgggaccgtaacgaacaacaaattgccacaggtcaacctttcagccgaagaaacagagttattaggctgttttgataaattcacaacatatttcgtcggcttttaccagaaccgtgagaacgtattttcaggggaggatattgctacagctattccgcatcggatcgtccaggataattttcctaaattccgggaaaactgtcggatttatcaggacttaatcaaaaatgaacctgcccttaaaccgctgcttcagcaagcagcggccgcggtgatggcccagaatccaaaggggatctatcaaccacgtaagagtctggacgatatttttgtcattccgttttataaccatctcctcttacaggatgatattgattatttcaatcaaatcttaggcggcatttcgggggcagccggtcagaaaaaaatccagggtttaaatgaaacaattaatctgtttatgcaacagcacccacaagaagccgataagttaaagaaaaaaaagattcgtcatcggtttattccgctgtataaacaaattctctctgaccgtacgtctttctcgttcatccctgaagctttttccaattctcaggaagcgttagacggcattgagacattcaaaaagtctcttaagaagaatgacacattcggcgcgttggagcggctgattcaaaatcttgcttccctggacctgaaatacgtgtatttatcgaacaagaaggtcaatgagatttcgcaggcattatacggcgaatggcactgcatccaagacgtcctcaagcaagatttcagccttgagagcctgatccagatcaacccacaaaattctagcaatggtttcctggccacacttaccgacgaaggcaagaaacgtatctcccaatgtcgtaacgtactggggaatcctcttccagtcaagcttgcggatgatcaagacaaagcgcaagtcaaaaaccaattggatacattactggctgctgtacactatctcgagtggttcaaggcagatccagacctggaaacagaccctaacttcactgttcctttcgaaaagatctgggaggaattggttcctttactttcactgtactctaaagttcggaattttgttacaaagaagccatattctacagctaaatttaaactgaactttgctaacccgacattagcggatgggtgggatattcacaaggaaagtgataacggcgcgctcctgtttgaaaagggtggtttgtattacttgggtatcatgaaccctaaagataagcctaattttaaatcctatcagggtgcagagccatactatcagaagatggtgtaccgtttttttcctgactgttcgaagaccatcccaaaatgcagcacccaacgtaaggatgtaaaaaagtacttcgaagaccaccctcaagcgacctcataccagatccacgactcaaagaaagagaagtttcgtcaggatttttttgagatccctcgggagatttacgagcttaataacaccacatacggcacaggtaagtctaaatataaaaaattccagacccagtattaccagaagactcaggataagtcaggctatcagaaagcacttcgcaaatggattgacttttccaaaaagtttcttcaaacatacgtcagtacttccatttttgatttcaaaggtctccgtccttcgaaggattatcaggacttaggcgagttctataaagacgttaattcgcgttgttaccgtgtgacgttcgagaaaattcgcgtacaggacatccacgaagcagtcaaaaatgggcaactgtatctcttccaattatataataaggacttctcacctaaaagccatgggttgcctaatcttcacactctctattggaaagccgtgttcgatcctgagaacttgaaggaccctatcgtaaaacttaatggccaagctgagttattctatcggccgaaatccaacatgcaaatcatccaacataagaccggggaggagattgtgaacaaaaagctgaaggacggcaccccggttcctgatgatatctaccgcgaaatcagtgcttacgtccaggggaaatgtcaaggcaacttatccccggaggcagagaagtggctcccaagtgtcacaatcaagaaagccgcccatgatatcacaaaggatcgtcgctttaccgaagataagtttttctttcatgtccctattacactgaactatcagagttcaggcaagccgacggcattcaactcgcaagtaaacgatttcttgaccgagcaccctgagacaaatatcatcggcattgatcggggtgaacgtaacttgatttatgccgttgtaatcactccagatggcaagattctcgaacagaaatcttttaacgtgatccacgactttgattatcatgaatccctgtcccagcgggaaaaacagcgggtagcagcgcgtcaggcttggacagcgattggtcgcatcaaggatctcaaggaaggttacctgtcgcttgtggtgcacgaaattgctcaaatgatgatcaaataccaagcagtcgtcgtattagaaaacctcaacacgggctttaagcgtgtgcgcggtggtatcagtgagaaggccgtctaccaacagttcgaaaaaatgttgattgaaaaattgaacttcctggtatttaaagatcgggcaatcaatcaggaaggcggggttctcaaagcttaccagctgacagactcgtttacgtcttttgcaaagttaggtaaccagtccggtttcctgttctacatcccgtccgcctacaccagcaaaatcgaccctggtacgggcttcgtcgatccttttatctggtctcacgtgaccgcttctgaggaaaatcggaatgaatttttaaagggctttgatagcttgaaatatgacgcccaatcatccgcctttgtactgcatttcaagatgaaatccaataagcaatttcagaagaacaatgttgaaggtttcatgccggaatgggatatctgcttcgagaaaaacgaggaaaagatttccttgcagggtagtaagtatacagccggtaaacgcattattttcgactccaaaaagaagcaatacatggagtgcttcccgcagaatgagctcatgaaagcactgcaggacgtaggcatcacctggaacacgggcaacgatatctggcaggatgtccttaaacaagcgagcacagatacagggtttcgtcaccggatgatcaacctgatccgttcagtgctccagatgcggtccagtaatggtgcgaccggggaggattacatcaattcacctgtgatggatctggacggccgttttttcgacactcgggcggggattcgtgatctgccattggatgccgacgccaacggcgcataccacatcgctttaaaagggcgtatggtactcgaacgcattcgctcccaaaagaataccgcgattaagaacactgactggttatacgcaatccaagaggaacgtaacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 791 - skipped

SEQ ID NO: 792 - RNA, 10 nt, synthetic construct
  misc_feature 1..10: note = Description of Artificial Sequence: Synthetic oligonucleotide
  source 1..10: mol_type = other RNA
taattcccac

SEQ ID NO: 793 - protein, 8 aa, synthetic construct
  REGION 1..8: note = Description of Artificial Sequence: Synthetic peptide
VSRKRPRP

SEQ ID NO: 794 - protein, 8 aa, synthetic construct
  REGION 1..8: note = Description of Artificial Sequence: Synthetic peptide
PPKKARED

SEQ ID NO: 795 - DNA, 21 bp, synthetic construct
  misc_feature 1..21: note = Description of Artificial Sequence: Synthetic oligonucleotide
  source 1..21: mol_type = other DNA
agcggcacaaggctcagctga

SEQ ID NO: 796 - DNA, 21 bp, synthetic construct
  misc_feature 1..21: note = Description of Artificial Sequence: Synthetic oligonucleotide
  source 1..21: mol_type = other DNA
cggaggctccttaccgatgtt

SEQ ID NO: 797 - DNA, 21 bp, synthetic construct
  misc_feature 1..21: note = Description of Artificial Sequence: Synthetic oligonucleotide
  source 1..21: mol_type = other DNA
cagaagacagggatgaagaga

SEQ ID NO: 798 - DNA, 21 bp, synthetic construct
  misc_feature 1..21: note = Description of Artificial Sequence: Synthetic oligonucleotide
  source 1..21: mol_type = other DNA
cactggaggtgcccgtgcaga

SEQ ID NO: 799 - DNA, 21 bp, synthetic construct
  misc_feature 1..21: note = Description of Artificial Sequence: Synthetic oligonucleotide
  source 1..21: mol_type = other DNA
taagtagtagcagcagcagca

SEQ ID NO: 800 - DNA, 21 bp, synthetic construct
  misc_feature 1..21: note = Description of Artificial Sequence: Synthetic oligonucleotide
  source 1..21: mol_type = other DNA
tatcagggaggctccccagtg

SEQ ID NO: 801 - DNA, 21 bp, synthetic construct
  misc_feature 1..21: note = Description of Artificial Sequence: Synthetic oligonucleotide
  source 1..21: mol_type = other DNA
cgactctgacagagctggtgg

SEQ ID NO: 802 - DNA, 21 bp, synthetic construct
  misc_feature 1..21: note = Description of Artificial Sequence: Synthetic oligonucleotide
  source 1..21: mol_type = other DNA
cagaagcaggaggtgaagaac

SEQ ID NO: 803 - DNA, 21 bp, synthetic construct
  misc_feature 1..21: note = Description of Artificial Sequence: Synthetic oligonucleotide
  source 1..21: mol_type = other DNA
tcccctccatacaggtcatag

SEQ ID NO: 804 - DNA, 21 bp, synthetic construct
  misc_feature 1..21: note = Description of Artificial Sequence: Synthetic oligonucleotide
  source 1..21: mol_type = other DNA
caggtgaaattcctgagatgt

SEQ ID NO: 805 - DNA, 21 bp, synthetic construct
  misc_feature 1..21: note = Description of Artificial Sequence: Synthetic oligonucleotide
  source 1..21: mol_type = other DNA
gacatcattgaccagagctct

SEQ ID NO: 806 - protein, 10 aa, synthetic construct
  REGION 1..10: note = Description of Artificial Sequence: Synthetic peptide
YLFQIYNKDF

SEQ ID NO: 807 - protein, 6 aa, synthetic construct
  REGION 1..6: note = Description of Artificial Sequence: Synthetic 6xHis tag
HHHHHH

SEQ ID NO: 808 - DNA, 3738 bp, Phocaeicola plebeius
  source 1..3738: mol_type = genomic DNA
atggaaacattttctgggtttacaaatttgtaccctttgtcaaagacattgcggtttagattgattcctgtaggggaaacattgaaacattttattgatagtggaatattggaagaagaccagcatagggctgagagttatgtgaaggtaaaggctattattgatgactatcatagagcttatattgagaattctttatcaggctttgaattacctttggaaagtacaggtaaattcaattctttggaggaatattatttgtatcataatattcgaaataaaacggaagaaattcagaacttgtcatccaaggtcagaactaatctgaggaaacaagtcgtggctcaactaactaagaacgaaatatttaaaagaattgataaaaaagagctgattcagagtgatttgattgattttgttaaaaatgagcctgatgcaaatgagaaaatagcactaatctcagaatttcgtaattttactgtatatttcaaaggttttcatgaaaaccgtagaaatatgtattcagatgaagaaaagtccacgtctatagcctttcgtctgattcatgagaatcttcccaagtttattgataatatggaagtgtttgcaaaaatacagaatacttctatctcggagaattttgatgctatacagaaagaactttgcccggagttggtaaccctttgtgaaatgtttaagttggggtattttaataagactttaagtcagaaacaaatagatgcttataatactgttataggtggtaaaaccacatcagaaggtaaaaagattaaaggtcttaatgaatatattaatctttataaccagcagcataagcaagagaaattacccaagatgaagcttcttttcaagcagatacttagtgatagagaaagtgcgtcatggctgccagagaagtttgagaatgatagtcaggttgtcggtgcaatagtgaatttctggaatactattcatgatacagttcttgcagaaggagggttgaaaacgattattgcttcattgggtagttatggccttgaaggtattttcctaaagaatgatttgcaacttactgatatatcacaaaaggcaacaggtagttggggtaaaatatcttctgagataaagcaaaaaatagaggtgatgaatcctcaaaagaaaaaagagtcttatgagacttatcaagaacgtatagataagatattcaagtcttataaaagtttttctttagcttttataaatgagtgccttcgtggtgagtataagattgaagattattttctcaagttaggggctgtgaatagcagttcgttacagaaagaaaatcatttttcgcatattctcaatacctatacagatgtgaaagaggtgattggcctttactctgaatcgactgacactaaattaatacaagataatgattccattcaaaagataaaacagttccttgacgcagttaaagacttacaggcttatgtaaaaccattattgggtaatggtgatgaaaccggtaaagatgaaagattttatggcgatttgattgagtattggagtttgcttgacttgattactcctttatataatatggttcgtaattatgtcactcagaagccgtattctgtagataaaataaaaataaatttccagaatcctactttattgaatggctgggaccttaataaagaaacggataatacatctgtaatattgcgtcgtgatggcaaatattatctggccataatgaataacaaatccagaaaagtctttttgaaatatccatcagggacagatagaaattgctatgagaagatggagtataaacttttaccaggtgctaataagatgctacctaaggtcttcttttcaaaatcaaggataaatgaattcatgcctaatgagcgtttgttgtcaaattatgaaaagggcacgcataaaaagtcgggtacttgttttagtttggatgattgtcatactttgatagatttctttaagaagtctttggacaaacatgaggattggaaaaactttggcttcaagttctctgatacttctacatatgaagatatgagtggtttttataaagaagtagagaatcaaggttataaattatcctttaagccgattgatgctacgtatgtggatcagcttgttgatgaaggtaagatttttctgtttcagatttataacaaggatttttctgagcatagcaaaggtacgcctaatatgcataccttgtattggaaaatgttgtttgatgaaacaaatcttggggatgtggtgtataaactaaatggtgaggctgaagtctttttccgtaaggcaagtataaatgtatcacatccaactcatccggctaacatacccataaagaaaaagaatcttaaacataaagatgaagaaagaattcttaaatatgacttgattaaagataagcgttataccgtcgaccagttccagtttcatgtgccaataaccatgaatttcaaggcggatggaaatggaaatataaaccagaaagcgatagactatttacgttcggcatcagatactcatataatagggattgaccgtggtgaacgaaacttgttatatcttgtagtgattgatggaaatggaaaaatctgtgagcaattctctttaaatgaaatagaagttgaatataatggtgaaaagtattcaacaaattaccatgatttgcttaatgtcaaggagaatgaaagaaagcaggcaagacagagttggcaaagtatagctaacataaaagacttgaaagaaggctatttaagtcaggttattcataagatttctgaattgatggtcaaatataatgcgattgtggtgcttgaggatttgaatgctggatttatgcgtggtcgacaaaaggttgaaaagcaggtttatcagaaatttgaaaagaaactcattgagaagttaaattatctcgtattcaagaaacagtcttctgatttgcctggtgggcttatgcatgcttatcagttagctaataaatttgagagttttaatactttaggtaaacaaagcggatttctcttttatatccccgcctggaataccagtaaaatggatccggtaacaggttttgtaaatttgtttgatgtgaagtatgaaagtgttgataaggcaaaaagctttttcagtaagttcgattctataaggtataatgtggaaagagatatgtttgaatggaaattcaattatggtgaattcacgaaaaaagccgaaggaactaaaactgattggactgtttgttcctacggtaatagaattatcacctttagaaatccggataaaaattctcaatgggataataaagaaataaatcttaccgaaaatattaagctgctgtttgaaaggtttggcatcgacttatcttcaaatctgaaagatgagataatgcaacgtacagaaaaagaattctttatcgaacttatatccctatttaagcttgtgctacagatgcgtaatagttggacaggtactgatatagattatctggtatcacctgtatgcaatgaaaacggtgaatttttcgatagcagaaacgtagatgaaacacttccgcaaaatgcggacgcaaacggagcatataacattgcaagaaaaggaatgatacttcttgataagattaagaaaagtaacggtgagaagaagcttgctctatctataactaatagagaatggctttcatttgctcaaggttgttgcaaaaatggatga

SEQ ID NO: 809 - DNA, 3738 bp, synthetic construct
  misc_feature 1..3738: note = Description of Artificial Sequence: Synthetic polynucleotide
  source 1..3738: mol_type = other DNA
atggagacattctcagggttcacgaacctgtaccctctgtcgaagaccttacgcttccgcctgattcccgtcggggagacgctgaaacacttcatcgacagcggcatcttagaagaagatcagcatcgtgcagaaagctatgtaaaagttaaggctattatcgatgattatcatcgtgcttatatcgagaacagcttgagtggctttgagcttcctttggaatccacaggaaaatttaatagcttggaggaatactatttgtatcacaatatccgcaacaagaccgaggaaattcagaatttatcatcaaaagttcgtacgaatttgcgtaagcaagtggtagcacaacttacaaagaacgaaatttttaaacgcatcgacaaaaaagaattgattcaatcagatttgattgatttcgtgaagaatgagccggatgcaaacgaaaagattgcattaatctcggagtttcgcaactttactgtctattttaaaggctttcatgagaaccgtcgcaatatgtattcagatgaggaaaaaagtactagtattgcttttcgcttgattcacgaaaatctgccgaagtttatcgataacatggaggtttttgctaagattcagaacacctccatcagcgagaatttcgacgcgattcaaaaagaactttgtccggaattagttactttatgtgagatgttcaagttgggttatttcaacaagacgctttcgcagaaacagatcgacgcctacaacactgtaattgggggaaaaacgacaagtgagggtaagaaaattaagggtctgaatgaatacatcaatttgtacaaccaacagcacaagcaggagaaattaccaaaaatgaagttgctgttcaaacaaatcctgagcgaccgcgaatcggcttcttggttacctgagaagtttgaaaatgattcccaggtggtgggggcgatcgtcaatttctggaacacaattcacgacaccgtcttggcggagggtgggcttaagaccatcatcgcgagtttgggctcctacgggttggagggtattttcttaaagaacgatctgcagttgacagacatcagtcaaaaggccactggaagttggggaaagatttcttcagaaattaagcaaaagattgaggtgatgaacccacaaaagaagaaagagtcatacgaaacctatcaagaacgcattgataaaattttcaagtcgtacaagagcttcagcttagctttcatcaatgagtgtttacgcggagagtacaaaattgaagattatttcctgaaactgggagcggtcaactctagttctctgcaaaaagagaaccatttcagtcacattttaaatacctacactgacgtaaaggaagttatcggcttgtacagcgaatctactgacaccaaactgatccaggataatgattctatccaaaagatcaaacaatttttggatgccgtaaaagacttacaagcctacgtgaaacctcttttgggaaatggggacgagacgggaaaggacgaacgtttctatggtgacttaatcgagtactggagcttacttgacttaatcaccccattatataacatggtgcgtaattacgtcactcaaaagccctattccgtagataagattaaaattaatttccagaatcctactttactgaacggttgggatcttaataaagagactgacaacacgtcggtcatcttacgtcgtgacggtaaatattatttggctattatgaataacaaatctcgcaaggtttttctgaagtacccctctggtaccgaccgtaactgctatgagaagatggagtacaagcttctgccgggggccaacaagatgcttcctaaagtgtttttctccaaaagtcgtatcaatgagtttatgcctaatgaacgtctgctttccaactatgaaaaaggaacccataaaaaaagtggtacatgcttctcgttggatgattgccacaccttaatcgactttttcaaaaagtcgctggataaacatgaagactggaaaaattttgggttcaaattttcggataccagtacatatgaagacatgagcgggttctataaggaagtggagaatcaagggtataaacttagttttaaacctatcgatgcgacgtatgtcgaccaattggtagatgagggtaaaattttcttatttcagatctataataaggatttttccgaacattccaagggaaccccaaatatgcacacgttgtactggaaaatgttgtttgatgaaactaatcttggtgatgttgtgtataagttgaatggggaagccgaagtcttcttccgcaaagcttcaatcaatgtttctcatcctactcacccggccaatatccctatcaaaaagaaaaacctgaaacacaaggacgaggaacgtatcttaaagtacgatttaattaaagacaaacgttacaccgtagaccagtttcagtttcatgtaccaattaccatgaactttaaggcagacgggaatggcaatatcaaccaaaaagcgatcgactatcttcgctctgcaagcgatactcacattattggaattgaccgcggcgagcgcaatctgttgtacctggttgtgattgatggtaacggaaaaatttgcgagcaattctccttaaacgaaatcgaggtagaatataacggcgaaaaatattccaccaactatcacgaccttcttaatgtgaaggagaacgaacgcaaacaggcccgtcaatcgtggcagtctattgcaaatatcaaagacctgaaggagggttacctttcccaggtcatccacaaaatctctgaacttatggtaaagtataacgctattgtagtattggaagaccttaacgcgggcttcatgcgtgggcgtcagaaagtcgaaaaacaagtataccagaagtttgagaagaaattgatcgaaaagttaaactatttagtgttcaaaaaacagtctagtgatcttcccggcgggttgatgcatgcatatcagttggcgaataagttcgagtcgtttaacacgttgggtaagcagtctggatttcttttttacattccggcgtggaatacttcaaagatggatcctgtcactggcttcgtgaatctgtttgatgtaaaatatgaatccgtcgataaggcgaaaagcttctttagcaaattcgactctattcgctataacgtagaacgcgacatgtttgagtggaagtttaattacggcgagttcacaaagaaagccgaggggacgaaaactgattggaccgtttgcagctacggcaatcgtattattacattccgtaatccggataaaaattcccaatgggataataaagagattaatcttacggagaacattaagctgttatttgaacgttttggaatcgatttgtcatccaatttaaaggatgaaatcatgcaacgcacggagaaggaatttttcattgaattaatcagcttgtttaagttggtgctgcaaatgcgcaacagttggacgggcaccgacattgattacttggtaagtcctgtatgcaatgaaaatggtgaattttttgactcacgcaatgtagatgaaaccctgcctcaaaacgctgatgcgaatggcgcgtataatattgcccgcaaggggatgattttactggataaaattaagaaatctaacggggaaaagaaacttgctttatcaattaccaatcgtgaatggttatcgttcgcacaaggttgctgcaagaacggatga

SEQ ID NO: 810 - DNA, 3738 bp, synthetic construct
  misc_feature 1..3738: note = Description of Artificial Sequence: Synthetic polynucleotide
  source 1..3738: mol_type = other DNA
atggaaacatttagcggattcactaatttgtacccactgtcgaaaactttgcgttttcgtcttatcccagtcggtgaaacgcttaaacactttattgactcgggtatcttggaggaggatcaacatcgcgcggaaagctatgtgaaagtaaaggcgattattgacgactaccatcgtgcatatattgaaaacagcctttccgggttcgagctgccgttagagtctactggaaagtttaacagcttagaagaatactatctgtaccacaacatccgcaataaaacagaggagattcaaaatctgagtagcaaggtccgtacaaacttacgtaaacaggtagtcgcacagttgacaaaaaatgagatttttaagcgtatcgacaaaaaagagcttattcaatctgatttaattgacttcgtgaagaacgaacccgatgcaaacgaaaagatcgcccttatctcggagtttcgcaacttcacagtgtactttaaagggtttcatgaaaaccgccgtaatatgtatagcgacgaggaaaagtcgactagtattgcgttccgtttaattcacgaaaatcttccgaagttcatcgataatatggaggtttttgcaaagattcaaaatactagcatttcggaaaattttgatgcaattcaaaaggagctttgtcctgaactggtgactttatgtgaaatgttcaaattggggtacttcaataaaaccctgtctcagaagcaaatcgacgcttataacactgtgattggcggcaaaactacgtcagaaggcaaaaaaatcaagggtttaaacgaatacatcaacttgtacaatcagcaacacaaacaggaaaagcttccaaagatgaagcttttgtttaagcaaattctgtccgaccgtgaaagcgcctcgtggttaccagaaaaattcgaaaacgattcccaggtagtgggggccattgttaacttttggaacactattcacgatacagtccttgctgaaggcggactgaaaacgattattgcgtcgcttggatcatatggattggagggtattttcttaaaaaatgaccttcaacttacggacatttcacaaaaagcaacaggaagttgggggaaaatctcgtcggaaatcaagcagaaaattgaagtgatgaacccgcagaaaaaaaaggaatcatacgaaacgtaccaagagcgcatcgacaagatttttaagtcctacaaatccttcagccttgcattcatcaatgaatgtttgcgcggtgagtataagatcgaagactacttcttaaagttgggtgccgtaaatagcagcagcttacagaaagaaaatcacttttctcacattcttaatacatatacggatgtcaaagaagtcattggcctgtattctgaatcaactgatacaaaattaattcaagataatgattccatccagaaaatcaaacagttcttagacgcagtgaaggatttacaagcctacgttaaaccattattgggtaatggtgacgaaactgggaaagatgagcgcttctacggtgatttaattgagtactggagtcttttagatcttatcacaccactttacaatatggtccgtaattacgttacccagaaaccttatagtgttgacaaaattaaaattaactttcagaaccccaccttattaaacggctgggacttaaacaaagagactgataacacttcagtgatccttcgccgtgatggtaagtactacttagcaattatgaacaataaaagtcgtaaagtttttctgaagtacccgtccggcactgatcgtaactgttacgaaaagatggagtacaagctgttacctggtgctaacaaaatgcttcctaaagtcttttttagcaagtctcgcatcaatgaatttatgccaaatgaacgtttactgtctaactacgagaagggtacccacaagaagtcagggacctgcttttctttagatgactgtcatactctgatcgatttcttcaagaagtctcttgataagcacgaagattggaagaatttcggcttcaaattttcagacacctctacgtacgaagatatgtctggattttataaggaggtggagaaccaggggtataaattatcgtttaagcctattgatgcaacttatgtcgaccaactggttgatgaggggaaaatctttctttttcagatttataacaaggatttctccgaacattcgaaggggactccaaacatgcacactctgtattggaaaatgttattcgatgagaccaacttaggcgacgttgtgtacaaactgaatggtgaggcagaagtatttttccgtaaagcttcaatcaatgtttctcaccctacccaccccgcgaatattccaatcaagaaaaagaatttgaagcataaggatgaagaacgtattttaaaatacgatctgatcaaggacaaacgttacactgtcgaccagtttcaattccatgtacctattaccatgaatttcaaagctgacgggaacggtaatattaatcaaaaagctatcgactacctgcgcagtgcgtccgacacgcatattatcggtattgaccgtggcgaacgcaacctgttataccttgtcgttatcgacggtaatggtaaaatctgtgaacagttttctttaaatgagatcgaggtcgagtataatggcgaaaaatactcaaccaattaccatgatttacttaacgtcaaagaaaacgagcgcaagcaagctcgtcaatcatggcagtcgattgcaaacattaaagatttaaaggaaggttatctttctcaggtaattcacaagatttccgagttaatggtcaaatataacgccattgtcgtgttggaggatctgaatgctggcttcatgcgcggacgccagaaggttgaaaaacaggtctaccagaagttcgagaagaaattgattgagaaactgaactatctggtttttaaaaaacagtcgtctgatctgccagggggcttaatgcacgcgtatcagttggctaataagtttgagtcgtttaacacacttgggaaacagtccgggtttctgttctatattcctgcgtggaatacatccaagatggacccagtcacagggttcgtcaacttgtttgacgtaaagtacgagtcagttgacaaagcgaaatcattttttagcaaatttgactctattcgctacaacgttgagcgcgatatgtttgagtggaagttcaattatggcgaattcacgaagaaagccgaggggacaaaaaccgattggactgtctgttcttatggcaatcgtattattacgtttcgcaacccagacaagaattcacaatgggacaataaagagattaatttaactgagaacattaagctgttatttgagcgttttgggatcgatctgtcgagcaaccttaaggacgaaattatgcaacgcacagagaaggaattctttattgaactgatctccctttttaaactggtgctgcaaatgcgtaacagttggacgggtactgatattgattacttagtgagtcctgtttgcaacgaaaacggggagttctttgactcacgcaacgtagacgagacattaccccagaacgccgatgcaaatggcgcctataatatcgcgcgtaaagggatgatccttttggataagatcaagaaatccaacggcgaaaaaaaattggcactgtcgatcaccaaccgcgagtggctgagttttgcacaaggatgttgtaaaaacggctga

SEQ ID NO: 811 - DNA, 3738 bp, synthetic construct
  misc_feature 1..3738: note = Description of Artificial Sequence: Synthetic polynucleotide
  source 1..3738: mol_type = other DNA
atggagacattctctggttttacaaacctttatcccttaagtaagactctgcgcttccgtttgattccagtaggcgagacactgaagcatttcattgactcaggcatcctggaagaggatcagcatcgcgccgagtcgtacgtcaaagttaaagcgattattgacgactatcaccgtgcgtacattgaaaactcgctttcggggtttgaattacccttggagtctaccgggaaatttaatagcctggaggaatactacttgtatcacaacatccgcaataaaactgaagaaatccagaatctgagtagcaaagtgcgtactaatcttcgtaagcaagtagtagcgcagctgacaaagaatgaaatttttaagcgcattgataaaaaagaactgattcaatcggacttgattgactttgtaaaaaacgaacccgacgcaaacgagaaaattgcgctgattagtgagttccgcaacttcacagtctattttaaaggtttccacgagaaccgccgcaatatgtacagtgatgaggaaaaatctacaagtatcgcatttcgtctgattcacgagaaccttcccaaatttatcgacaacatggaagtcttcgccaagattcagaatacctccatctcggagaatttcgacgctatccaaaaggagttgtgtcccgaactggtgactttatgtgaaatgttcaagctgggctattttaataagacattatcccagaaacagatcgatgcgtataacacagtaattggcggaaaaacaacatctgaagggaaaaagatcaaaggacttaatgagtacatcaacttatacaaccaacagcacaagcaggaaaagcttcctaaaatgaaacttttgttcaaacagatcttaagcgatcgcgaatctgcttcttggctgccagaaaagttcgaaaatgatagccaggtagttggggccattgtgaatttctggaacaccatccacgacaccgtacttgcggaaggagggctgaagactattattgcttcgttgggctcctacgggcttgaaggaatcttccttaaaaatgacttgcaactgaccgatatctctcaaaaagctacaggatcatggggaaaaatcagctcagaaattaaacagaagattgaggttatgaacccgcagaagaagaaagaaagctatgaaacgtaccaagagcgtattgacaaaatctttaagtcgtacaagtcttttagtttggcattcattaacgagtgcttgcgcggtgagtacaaaattgaggactacttcttaaagttgggtgctgtaaatagctccagtctgcagaaggaaaatcatttctcacacattcttaacacgtataccgacgtaaaggaagtgattggtctgtactcggaatccacggacactaaattaatccaagacaacgactctattcaaaagattaaacaattcctggacgcagtgaaagatttacaagcttatgtaaagccacttttaggtaacggagatgaaactgggaaggatgagcgtttttatggtgatctgattgagtattggtctttattagacttaatcacgccattgtacaacatggtacgtaactatgtcacacagaaaccttattcggtggataaaatcaagatcaatttccagaatccaactctgctgaatggatgggatctgaataaggaaactgataatacaagcgtcattctgcgtcgtgacggcaaatactatttggcaattatgaacaacaagtcgcgcaaagtgttcctgaagtaccctagcggaactgatcgtaactgttacgaaaaaatggagtacaagcttcttccgggtgcgaataagatgttacctaaagtattcttctctaagagccgcatcaatgagttcatgccgaacgaacgtttgttatccaactacgaaaaaggaacgcacaagaagtcgggtacatgcttttcgcttgatgattgtcacacgttgattgatttttttaagaagagcttggacaaacacgaagattggaagaactttggatttaaattctcagatacttcgacctatgaagacatgtccgggttctataaagaagtggaaaatcaaggatataagctgagcttcaaaccaattgatgcgacctatgtagatcaactggtcgatgaagggaagatctttttattccaaatctataataaagacttctcagagcattccaagggaacgcccaacatgcacacgttgtactggaaaatgctttttgatgaaactaatttaggtgacgtggtgtataaattgaatggtgaagctgaagtattctttcgtaaggcaagtatcaatgtctctcatccgacgcatccagctaatattcccatcaagaagaaaaacctgaaacacaaagatgaagaacgtatcttgaagtacgacttgatcaaagataagcgttatacagtagaccagttccaattccatgtgcctatcaccatgaattttaaagcagatggaaatggaaatatcaatcaaaaagccatcgactacttacgctccgcttcagatactcacattatcggcattgaccgcggagagcgcaatctgttgtatctggtagtgatcgatggtaatggaaagatttgtgaacagttctcattaaacgaaattgaagtagagtataatggtgaaaagtattctacaaactaccatgatttattgaatgttaaagaaaatgaacgtaaacaggctcgccagagctggcagtctatcgcgaatattaaggatctgaaagagggatacctttctcaggtgattcataagatctccgagctgatggtcaaatacaacgccatcgttgtgttagaggaccttaatgcaggtttcatgcgcgggcgccaaaaggtagagaaacaagtataccagaagtttgagaagaaactgatcgaaaaacttaactacttagtgttcaaaaaacagtctagcgatctgccaggcgggcttatgcatgcttatcaactggccaataagttcgagtccttcaacacgttgggtaaacaatctggatttcttttctacattccggcatggaatacgtctaaaatggatcctgtgactggctttgtgaatttatttgatgttaagtatgagagtgtagataaagcgaaaagtttcttttctaaatttgactccattcgctataatgtggaacgtgatatgtttgagtggaagttcaattatggtgagttcaccaaaaaggctgaagggaccaagacagactggactgtgtgcagttatggaaaccgcatcattacttttcgcaaccccgataaaaattctcaatgggacaacaaggagattaacttgacagaaaatatcaagcttttgtttgaacgcttcggcattgatctttcttcgaaccttaaggacgagatcatgcagcgtactgagaaggagttcttcattgaattaatttcattgttcaaattggtcctgcaaatgcgtaatagctggactggtactgacatcgattatttggtctctcccgtgtgtaacgagaatggagagtttttcgactcgcgtaacgtcgatgaaactttgccccaaaacgcagacgccaacggtgcctacaacatcgctcgtaaggggatgatcctgttagataaaatcaagaaatcaaacggagaaaagaaactggctctttctattactaatcgtgagtggctgtcgtttgctcaaggatgctgtaagaatggttga

SEQ ID NO: 812 - DNA, 3594 bp, Sulfurimonas crateris
  source 1..3594: mol_type = genomic DNA
atgttgtcaaattttacaaatcagtaccaactttcaaaaaccttgcgttttgaactcaaacctgtaggtgatacacttaagcatatagagaaaagtggcttgatagcacaagatgaaatacgctcacaagagtatcaagaagtaaaaacgattatcgataaataccacaaagcttttattgatgaagcacttcaaaatgttgtgcttagtaatcttgaagagtacgaagcactttttttcgagagaaatcgcgatgaaaaagcttttgaaaaattgcaagctgtattgcgtaaagagatagttgcacattttaagcaacaccctcaatacaaaacactttttaaaaaagagcttattaaagctgatttgaaaaattggcaagaactaagcgacgcagaaaaagagcttgtaagccactttgataacttcacaacctactttacaggttttcatgaaaatcgtgccaatatgtacacagatgaagcgaaacactcttctatcgcttaccgtattatccacgaaaatttgcctatttttttaacaaataaaaaactttttgaaacaatcaagcaaaaagcaccacaccttgcacaagaaacgcaagatgccttgcttgaatatttaagtggtgcaatagttgaagatatgtttgagcttagttattttaaccacctactttcacagactcatatcgatctatacaaccaaatgattggcggagtcaaacaagatagtttaaaaattcagggtttaaacgaaaaaatcaatctctatcgtcaagcaaacggcttgtcaaaacgtgaactgccaaatctcaaaccactacacaaacagatacttagtgatcgtgaaacactctcttggcttcctgaatcatttgaaagcgatgaggaacttatgcaaggtgtgcaagcatattttgagagtgaagtattagcttttgagtgctgcgatggtaaggtcaatcttttagagaaactgcctgagcttttgcaccaaacacaagattatgatttttcaaaagtttatttcaaaaacgatctagcacttacagctgcttcgcaagcgatttttaaagattatcgcattataaaagaagcactttgggaagtgaataaacctaaaaaatcaaaagatttagtggcggatgaagagaagttttttaacaagaaaaatagctattttagtattgagcaaatagatggtgccttaaatagtgcgcaactctccgctaacatgatgcactatttccaaagtgaatctacaaaggtaatcgagcaaattcaattgacttacaatgattggaagcgaaacagttcaaataaagaacttctaaaagcttttttagacgcgcttttatcgtatcaacgtcttttaaaaccgcttaatgctccaaacgatcttgaaaaagatgttgctttttatgcctacttcgatgcttattttacgagtttatgcggtgtagtcaagctttacgacaaagtaagaaactttatgaccaaaaagccgtattcacttgaaaaatttaaactcaattttgaaaactcgacactacttgatggttgggatgtcaataaagagtctgataatacggcaattttatttcgcaaagagggcttgtattatctaggtattatgaataaaaagtataacaaagtatttcgcaatatttctagttcacaagatgagggttaccaaaaaattgactataaactattaccaggtgcgaataaaatgcttccaaaagtctttttttctgataagaataaggaatattttaagccaaatgctaagttacttgagagatataaagcgggagagcataaaaaaggggataatttcgacttagatttttgtcacgaattaatagacttttttaaaacttcaatcgaaaaacatcaagattggaaacattttgcttatcagttttcaccgactgagagttacgaagatttaagcggtttttatagagaggttgaacagcaaggttataaaatcagttataaaaatattgcagcaagttttatcgatacattagttgcagaaggtaaactctattttttccagatctacaacaaagacttttctccctatagtaaaggtacgccaaatatgcacactctttattggcgtgcactttttgacgaaaagaatctagctgatgtgatctacaaacttaacgggcaagcggagatatttttccgtaaaaaatcgatcgagtactcccaagagaagctgcaaaaagggcatcaccacgaaatgcttaaagataagtttgcttatccaattatcaaagatcgtcgttttgcttttgataagttccagtttcatgtaccaataacgctcaactttaaagcagagggtaatgaaaacattacgccaaaaacatttgaatacattcgatctaatcccgacaacataaaagttataggtatagatcgtggtgagcgtcacttactctatctttcactcattgatgcagagggtaagatcgtagagcagtttacgctcaatcaaattattaatagctacaacgggaaagaccacgtcatagattatcatgccaaacttgacgcaaaagaaaaagaccgcgacaaagctcgaaaagagtggggaactgtcgaaaacatcaaagaactaaaagagggctatttaagccatgttatccataagatagcaactcttatcattgaacacggtgcagttgtagcgatggaagatctcaactttggctttaaacgtggacgtttcaaagttgaaaagcaagtctatcaaaaatttgaaaaagcacttatcgataagctgaactatcttgtcgataagaaaaaagagcctcataaacttggaggtcttttaaatgcgttgcaactcactagcaagtttcaaagttttgaaaaaatgggtaaacaaaacggctttttgttttatgtacctgcgtggaatacatccaaaatagatcctgttacgggttttgttaatctttttgatacccgttatgcaagtgtagaaaaatccaaagcattttttactaagtttcaatcaatttgctacaacgaagctaaagattacttcgagttagtatttgattataatgatttcacagaaaaagctaaagaaactcgaagcgagtggacactttgtacttatggtgaacgcattgtgagctttagaaacgcggagaaaaatcatcaatgggatagcaaaacaattcatcttacaacagagtttaaaaacctttttggtgagctgcatggtaatgatgtaaaagagtatattttagagcaaaattcagttgagttttttaagtcacttatctatttattaaaaattactttgcagatgcgtaactcaatcacgggtactgatatagactatcttgtctcacccgtcgcagatgaagcagggaatttttacgacagtcgtaaagccgatacatctttaccaaaagatgccgacgcaaacggtgcgtataatatcgctcgtaaaggtttaatgttgatgcatcgcatccaaaacgccgaagatctcaaaaaagtgaacttggcgatttcaaaccgtgactggctccgcaacgctcaaggactggataaatga

SEQ ID NO: 813 - DNA, 3594 bp, synthetic construct
  misc_feature 1..3594: note = Description of Artificial Sequence: Synthetic polynucleotide
  source 1..3594: mol_type = other DNA
atgctgagtaactttaccaaccagtatcagttatccaagaccttacgtttcgaattgaagccggtcggggatacgttgaaacacatcgagaagagtgggttgatcgcccaagacgaaatccgttcccaagagtaccaagaggttaaaacaatcatcgacaagtaccacaaagcctttatcgacgaagctttacaaaatgtggtgttatccaatcttgaggaatacgaagctcttttcttcgaacgtaatcgtgacgagaaggcgttcgagaaattgcaagctgtattgcgcaaagaaattgtagcacattttaaacaacatccccaatataagaccctttttaagaaggagttaatcaaagctgacctgaaaaattggcaagaactgagcgatgccgagaaagagttggtctcgcactttgataactttactacatacttcacgggtttccacgagaatcgcgccaatatgtacacggacgaggcgaagcacagcagtatcgcctaccgtattattcacgaaaatcttccaatctttcttactaacaagaaactgttcgaaaccattaagcagaaagctccacatttagcccaggaaacgcaggatgcattattggagtatttatccggagccatcgtggaagatatgtttgaacttagttatttcaaccacttgctgagtcagacgcatattgatctgtataatcagatgattggtggagttaagcaggatagtttaaagattcagggtctgaatgagaagattaatctttaccgtcaagcgaatgggctttcgaaacgtgaattgccgaatcttaaaccgctgcataaacaaattctgtcggatcgtgagacattatcttggcttccggaatctttcgagagtgacgaggagctgatgcaaggggtccaggcatatttcgaatctgaagttcttgcctttgaatgttgcgatgggaaggttaacttattagagaaactgccggagttgttacaccaaacacaggattatgattttagtaaagtttacttcaagaacgatttagcattgaccgctgcatcacaggcaatctttaaagactatcgtatcattaaggaggcgttgtgggaggttaataagccgaaaaaatctaaagacttagtcgctgacgaggaaaaattctttaataagaagaactcctacttctctattgagcagattgatggagcgttgaactcggcgcagctgagcgctaacatgatgcactattttcagagtgaatctacaaaggttattgaacaaatccaattgacttataacgactggaagcgtaacagtagcaacaaggaattgcttaaggcattccttgacgcactgctttcttatcagcgtcttttaaagcctttaaatgcccctaatgaccttgagaaggatgtggcattctatgcctactttgacgcctactttacaagcctgtgtggtgtcgttaaactgtacgacaaggtacgtaatttcatgaccaagaagccgtattcgttagagaaatttaagttgaattttgaaaactcgacgcttttagacggttgggatgtcaataaagaatccgacaacactgctattttatttcgtaaggaggggttgtactatctgggtattatgaataaaaagtacaataaggtctttcgtaatatttcatcatcccaagacgagggctatcaaaaaatcgactataaattacttccaggggccaataagatgctgccaaaagtgtttttcagtgataagaataaggagtatttcaagccaaacgccaagctgttggaacgttacaaagccggtgagcacaaaaaaggggataactttgatcttgacttctgtcacgaattgatcgactttttcaagacaagcatcgaaaagcaccaagactggaaacacttcgcctaccagtttagtcccaccgaatcgtacgaggacctttcaggtttttaccgtgaggtggaacaacaggggtacaaaatcagttacaaaaatatcgctgctagctttatcgatacgctggtggcagagggtaaactgtattttttccagatttacaacaaggatttcagtccatactcgaagggaactcccaacatgcacaccttatattggcgtgccttgttcgacgagaagaacttagcggatgtaatttataagttgaacggtcaggccgaaattttttttcgtaaaaagagcatcgaatattcgcaggaaaagttacaaaaggggcaccaccatgagatgttaaaggataagtttgcgtacccaattatcaaggatcgccgctttgcctttgacaagttccagtttcacgtgcctattacactgaattttaaagcggagggcaatgagaatatcactcctaagacgtttgaatatattcgctcgaatcctgataacattaaggtgattgggattgatcgcggcgagcgccacttactttacctgagtttaatcgacgcggaaggtaagattgttgaacagtttacattaaaccaaattatcaatagctacaatgggaaagaccatgtgattgactatcatgccaaattggatgcaaaggaaaaagatcgcgataaggctcgcaaggaatgggggactgtggaaaatatcaaggaattgaaagaaggttatttaagtcatgtaatccataaaatcgcaacccttattatcgagcatggcgctgttgtagcaatggaagaccttaattttggcttcaagcgcgggcgtttcaaagtggagaagcaggtgtatcagaaatttgagaaagctttaattgataaattgaattatttggttgataagaaaaaagagccgcataagttaggtggcttgttgaatgctttgcaattaacgtcaaaatttcagtctttcgaaaagatgggaaaacagaacggtttccttttctatgtgccagcctggaacacatcaaaaattgaccccgtcactgggtttgtaaacctgtttgatactcgctatgcaagcgttgaaaaaagtaaagctttcttcacgaagttccagtcaatttgctacaatgaggccaaggactactttgagttggtgttcgactacaatgactttacagagaaggctaaagaaacacgttcagagtggaccttatgtacatatggggagcgcatcgtgtcttttcgcaatgccgaaaaaaaccaccagtgggactccaaaacgattcatttgaccactgaatttaagaatttatttggggaattgcatgggaatgatgtaaaagagtatattctggaacaaaattctgttgaatttttcaaatcactgatttatcttcttaagattactcttcagatgcgcaattctatcacgggcaccgacattgactacttagtctctccggtcgcagatgaagctgggaatttctatgactcccgtaaggcggacacaagtcttccgaaagacgctgatgcgaacggtgcatacaatatcgcgcgcaaaggactgatgctgatgcaccgtatccagaacgcggaggacttgaagaaggtaaatttggccatctcaaatcgtgattggttgcgcaatgcccaaggtttagataaatga

SEQ ID NO: 814 - DNA, 3594 bp, synthetic construct
  misc_feature 1..3594: note = Description of Artificial Sequence: Synthetic polynucleotide
  source 1..3594: mol_type = other DNA
atgttaagcaacttcaccaatcagtatcagctaagtaagactctgagattcgagcttaagcctgttggcgataccctaaaacacattgagaaatcaggtctaatagctcaggacgaaattcgtagccaagaatatcaggaagtcaagactattattgataaataccacaaggcctttattgatgaggccctacagaatgtagtcctaagcaatctagaagaatacgaggccttatttttcgaaagaaacagagacgaaaaagcgttcgagaaattacaagcagttttaagaaaggaaatcgtcgctcactttaagcagcacccgcaatataaaacattattcaagaaagagctaatcaaggctgacttaaagaattggcaagaattatccgatgccgagaaagaattggttagtcacttcgacaatttcacgacgtatttcacaggatttcatgagaaccgtgcgaacatgtataccgatgaagcaaaacacagttccatagcttatcgtatcattcacgaaaatctgccgatattcttaactaacaagaaattgtttgagactataaagcaaaaggcgccacatttagcccaagaaacacaggacgctttattggaatatctgagcggggccattgtagaggatatgtttgaactttcatactttaaccaccttttatcccagacccacattgacttatataatcaaatgataggtggggtcaagcaagactcactgaaaattcaaggccttaacgaaaagatcaatttatacaggcaggcgaatggtttgagtaagcgtgaattgccgaatctgaagcccctgcacaaacaaattctgtctgatcgtgaaactctttcctggcttccagaatctttcgaatctgatgaggaactgatgcagggtgtccaagcctacttcgagtctgaagttttagcattcgagtgctgcgatggtaaagttaacctactggagaaactgcccgagcttctgcatcaaacccaggattacgatttctctaaggtatatttcaaaaacgacttagccctaacagcggctagtcaggcaatatttaaggattacagaattattaaagaggctctgtgggaggtgaataaaccgaaaaaatctaaggaccttgtcgccgacgaagaaaagttttttaataaaaaaaacagctattttagcatagaacaaattgacggggcattgaactcagcacaactatctgctaacatgatgcattattttcaaagcgaaagcaccaaggtcattgaacaaattcagttaacttataacgactggaagaggaactcatctaacaaggagctgttaaaggcttttttggatgcattattgtcttatcaaagattgctgaaaccgttgaacgctccaaatgatcttgagaaggacgtagcgttctacgcttacttcgatgcatattttacttccctgtgcggtgtcgtaaagctatatgacaaggtcaggaatttcatgactaaaaaaccatactcacttgaaaaatttaaacttaatttcgaaaattcaacgttattagatggttgggatgtcaataaagagagcgacaatacggctatcctgtttcgtaaagagggtttgtattacctgggaatcatgaataaaaagtacaacaaggtcttcagaaacattagttcatctcaggacgagggttatcagaaaatcgattataaattgttgccaggtgctaacaagatgctgccgaaagttttcttcagcgacaaaaacaaagagtactttaaaccaaacgcaaagttgttggagaggtataaagcgggagagcataagaagggggataattttgatcttgacttctgtcatgaattgattgacttctttaagactagcatagagaagcaccaagattggaaacacttcgcatatcaattcagccccactgagagctacgaggatttatccggcttttacagggaagtagagcagcagggttataagatcagttacaaaaacatagcggcttcttttatagatactttagtagccgagggtaaattatacttctttcaaatttataacaaggatttctccccttattctaagggcactcctaatatgcatactttatattggagggctctttttgacgagaagaacctggcagatgtcatttataagctaaatgggcaagcggaaatttttttccgtaagaagagcatagaatattctcaggagaagctgcaaaagggacatcaccacgaaatgctaaaagacaaattcgcctacccaatcataaaagatagaagatttgcttttgacaaattccagtttcacgtacctatcacattaaactttaaggccgagggaaatgagaacataacaccgaaaacatttgaatatatacgttctaatccagacaatattaaggtgataggaattgaccgtggtgagaggcaccttctatatctatctctaatagacgcagaaggaaagatcgtagaacagtttactctgaaccaaatcataaacagttacaatggcaaggaccacgtaatcgactatcacgctaaattggacgccaaagagaaggatagagacaaggctcgtaaggaatggggtactgtggaaaatatcaaagagcttaaggagggctacctttcacatgttatccacaaaatcgcgactctgataatagaacatggggcagttgtggccatggaggatctaaacttcggattcaagcgtggcagatttaaggtagaaaagcaggtttaccagaagtttgaaaaagccctgatagataaattaaactatctggtcgacaagaagaaagaaccccataaactgggagggttacttaacgcgttacaattgacgagcaagttccaatcctttgagaagatgggcaagcagaacggatttcttttttacgtaccggcatggaacacaagtaaaattgatcccgtcactgggttcgttaatctgtttgacactagatatgccagcgtcgaaaagagcaaagcattttttacaaagtttcagtccatctgttataatgaagccaaagattacttcgaacttgtttttgattacaacgatttcaccgaaaaagctaaagaaactcgttccgaatggacgctatgcacctacggtgaaagaatcgtatccttcaggaacgcagaaaagaaccaccagtgggattccaagactatccatttaacgacggagttcaaaaatcttttcggtgaactacatggcaacgacgtgaaagagtacatacttgaacaaaacagtgtagagttctttaagagtttaatttacttgctgaagatcacgctacagatgagaaactcaataacgggtacggatatcgactacctagtaagtcccgttgctgacgaagcaggcaatttctatgatagtaggaaggctgacacctcacttccaaaagacgcagacgccaacggcgcctataatattgccaggaaaggtcttatgttaatgcatagaatccagaatgccgaagacttaaaaaaagtgaaccttgcaatatctaacagagactggcttcgtaatgcccagggcttagataaatga

SEQ ID NO: 815 - DNA, 3594 bp, synthetic construct
  misc_feature 1..3594: note = Description of Artificial Sequence: Synthetic polynucleotide
  source 1..3594: mol_type = other DNA
atgttgagcaattttacgaatcagtaccaactgtcaaaaacccttagattcgagctcaagcccgtcggggacacgcttaagcacattgagaagagcgggctgatcgctcaagatgaaatacgatctcaagaatatcaagaagttaaaacgatcatcgataagtatcataaggcgtttatagatgaggcattgcagaacgtggtactgtctaatttggaggaatacgaagcattgttcttcgagcgaaatcgggacgagaaggctttcgaaaagttgcaagccgtgttgcgaaaggaaatagtagcgcatttcaagcaacatccgcaatacaaaacattgtttaaaaaagaacttattaaggcagatctcaagaactggcaagagttgtctgatgctgaaaaagagctggtctcccactttgacaatttcacaacttatttcacagggttccacgaaaatcgcgccaacatgtacacggacgaagcaaagcactcctctattgcgtaccggattatccatgaaaatctgcccatctttctcacgaacaaaaagctctttgaaaccattaagcaaaaggcaccgcatttggctcaggagacccaggacgccctgcttgaatacctgagcggcgcgattgtggaggacatgttcgaactttcctatttcaaccatcttctgtcacaaacccacattgacctgtataaccaaatgattggaggggttaaacaggattccctgaagatccagggcctcaatgagaaaatcaacctttacagacaagccaacggtctttctaaaagggaactcccgaacctcaagcctcttcacaagcaaattttgagcgatcgggaaactcttagttggctcccggaaagcttcgaatccgacgaagagcttatgcaaggagttcaagcctacttcgaaagtgaagtgcttgcattcgagtgttgtgacggcaaagtaaatctgttggaaaagcttcctgagctcttgcatcaaacccaagattatgatttttcaaaggtctattttaaaaacgatctggctcttacagcagcctcccaggccatcttcaaagactaccgaattattaaggaggccctctgggaagttaataagcctaagaaatccaaagatttggttgcggacgaggaaaagttctttaataaaaagaatagctatttttctattgagcagatcgacggcgctttgaactctgctcaactgtcagcaaatatgatgcattactttcagtctgagagcacaaaagtaatcgaacaaattcaattgacctacaacgattggaagcggaacagctctaataaagagcttctgaaagcttttctcgatgcgctcttgtcctaccaaaggctcctcaagccactgaacgcaccaaacgatcttgagaaggacgtcgccttctacgcttactttgatgcatattttaccagcctttgtggtgtagtcaagctgtacgacaaagtacggaattttatgacgaagaagccttacagcctcgagaaatttaaactcaactttgaaaactcaacccttcttgatgggtgggatgtcaataaggagtccgacaatacggctatactttttaggaaagaaggtctctattaccttgggattatgaacaagaaatacaacaaagtattcaggaacataagttccagtcaggatgagggttatcagaaaattgactacaagctccttcctggcgctaacaagatgctcccgaaggtatttttcagcgacaagaataaggaatattttaagcctaatgcgaaattgctcgaacgatataaggccggcgaacataagaagggcgataactttgatcttgacttttgtcatgaactgatagatttctttaaaacgagcatcgagaagcatcaagactggaagcactttgcctaccaattctcacctaccgaatcatacgaagatctgtccggtttttatcgagaagtggaacaacaagggtataaaataagctacaaaaatattgcagcgtccttcatagatacattggtcgcggagggtaagctctacttttttcaaatttacaacaaggacttttcaccctatagcaagggtacccccaacatgcacacactgtactggagagcactctttgatgagaagaacctcgctgacgtcatttataaactgaacggtcaagcagaaatattcttccggaaaaaatctattgagtattcacaggagaaattgcagaaaggacaccatcacgagatgctgaaagacaagttcgcgtatcctattataaaagacaggcgattcgcgtttgataaattccagtttcacgtccctatcacgcttaatttcaaggcagaagggaacgaaaacattacccctaagacattcgaatacattaggagcaacccagataacattaaggtgattggaatcgataggggtgaacgacacttgctgtacctttcactcatcgatgctgagggtaagattgttgagcaatttacgttgaatcaaatcatcaattcctataacggaaaagatcacgttattgattatcacgctaaactcgatgctaaagaaaaggacagagataaagccaggaaagagtggggtacagttgaaaatattaaagaacttaaggaagggtacttgtcacatgttattcacaagattgcaaccctcataattgagcacggggctgtcgtggctatggaagacctcaactttggctttaagcggggacgatttaaagttgagaagcaggtataccaaaaattcgagaaggcgctgattgataagctcaattatctcgtggacaagaagaaggaaccccataagctggggggactccttaatgccctgcagttgacttcaaaattccaatccttcgaaaaaatgggtaagcagaacggatttttgttttacgtacccgcttggaacacctcaaaaattgacccggttaccggcttcgtgaatctctttgacacgcgatacgcttcagttgaaaagtccaaggcttttttcacgaagttccagagtatttgctacaatgaagctaaagactattttgagctggtattcgattacaacgactttacggagaaagccaaggagactcgcagtgagtggaccctttgtacttatggtgagaggatcgtatcattccgcaacgccgagaagaaccaccaatgggactcaaagacgatacatcttaccacagaatttaagaatcttttcggggagctgcatggcaatgacgtaaaggaatatatcctcgagcagaactcagtcgaatttttcaagagtcttatatacctcttgaaaataacactccagatgcggaacagcatcacggggaccgatatcgactaccttgtttcacccgttgccgatgaagccggtaacttctacgacagtcgcaaggcggatacatcacttcctaaagacgccgacgcaaacggtgcttataatatagcccgcaaagggctcatgttgatgcaccgaatccaaaatgctgaagatttgaaaaaagttaaccttgctataagcaaccgagactggctgcggaacgcacagggtctcgacaaatga

SEQ ID NO: 816 - DNA, 3594 bp, synthetic construct
  misc_feature 1..3594: note = Description of Artificial Sequence: Synthetic polynucleotide
  source 1..3594: mol_type = other DNA
atgttgtccaattttactaatcagtaccagcttagcaaaacacttcgcttcgagttaaagcctgttggtgacacgcttaaacacattgaaaagtcgggactgatcgcacaggatgagattcgctcacaggaatatcaggaggtaaagaccattatcgacaagtatcataaagccttcattgatgaagcattgcagaatgttgtgctgtcaaacctggaagaatatgaagcgttatttttcgaacgtaaccgcgacgaaaaggcgtttgagaaacttcaagccgtactgcgtaaggagatcgtggcccactttaagcagcaccctcagtataaaacactgttcaaaaaggagttgattaaagctgatctgaagaactggcaggagttatcggatgcagagaaagagcttgtaagccattttgacaacttcaccacgtatttcaccggctttcatgaaaaccgtgcgaatatgtataccgatgaagcaaaacattcttcaattgcttaccgcatcatccatgaaaaccttccaatttttcttacaaacaagaaactttttgaaacaattaaacaaaaggcgccgcacctggcgcaagaaacccaggatgccctgttagagtatttatcaggcgctattgtagaagatatgtttgagctgagttattttaaccacttgctgagtcaaacgcatatcgacctttataatcaaatgattgggggcgtgaaacaggattcgttaaaaatccaaggacttaacgagaagatcaatttgtaccgccaggcgaacgggctgtcaaaacgcgagttgccaaatttgaaaccgttgcataaacagattttatccgaccgcgagacgttgtcgtggttacccgaatcctttgagtccgacgaagaattgatgcaaggtgttcaagcttattttgaatcggaggtcctggcctttgaatgctgcgatgggaaggtaaacctgttggagaagttgccagaacttctgcaccaaacccaggactatgatttcagcaaggtatacttcaaaaacgacctggcgttaactgctgcctctcaggccattttcaaagattaccgcattattaaggaggccctgtgggaggtgaacaaaccaaaaaagagtaaggatttggtagcagatgaggaaaaattcttcaataagaaaaatagttatttcagcatcgaacaaattgacggtgccttaaactcagcccaattgtcggctaatatgatgcattattttcagtcggagtcaacgaaagtcatcgaacagattcagctgacctataatgattggaagcgcaactcatctaataaggaattgctgaaggccttcctggatgcgttactgtcgtaccagcgccttcttaagccgttaaacgccccgaatgacttagagaaggatgtagcgttctacgcctatttcgacgcgtatttcacatctctttgtggggttgtgaagttatatgataaagtccgtaactttatgaccaagaaaccatattcactggaaaagttcaagctgaattttgagaattcgacgttgttagatggctgggatgtgaacaaggagtctgacaacacagctattttatttcgcaaagagggtctttactatcttggaatcatgaataagaagtataacaaggtctttcgcaacatcagttccagtcaggacgagggataccagaagatcgattacaaattgttaccaggagctaataagatgttgcccaaagtgtttttctcggataagaacaaagaatacttcaagcctaacgccaaactgttggaacgctataaggcgggagaacataagaaaggtgataattttgacttagatttttgtcatgagcttatcgactttttcaagacatcgattgaaaaacatcaggattggaagcattttgcctaccagttctcccccacagagtcgtacgaggacctgagtgggttctatcgcgaagttgaacaacaaggatataaaatttcctacaaaaatatcgcggcgagctttatcgatacactggtcgcggaggggaaactttatttcttccagatctataacaaagacttctcaccatattctaagggcactccgaatatgcacaccttgtattggcgcgcactgttcgatgagaagaacttggctgatgtgatctataaactgaatggtcaggcggaaattttctttcgcaaaaaatccatcgaatattcgcaggaaaagcttcagaaaggtcaccaccatgaaatgttgaaggataagttcgcctaccccattattaaggatcgtcgttttgctttcgacaaattccaattccacgtgccaatcacattgaattttaaagctgagggcaatgagaacatcacgccaaaaacgtttgagtatatccgctcaaatccagataacatcaaggtgatcgggatcgatcgtggagagcgtcaccttctgtatttgtcgttgatcgacgcggagggcaagatcgtggagcaatttacgcttaaccagattattaatagctataatggtaaggaccacgtcattgattaccatgccaagctggatgctaaggagaaggaccgcgacaaggcgcgcaaggaatggggaacagtcgagaatatcaaagagctgaaagaggggtacttatctcatgtcattcacaaaatcgccacgttaattatcgagcatggggccgtggtagcaatggaggatctgaactttggcttcaaacgtggtcgctttaaagtggagaagcaggtataccaaaaatttgaaaaagcacttatcgacaaacttaactacctggtggacaaaaagaaagaaccacataaattaggcggcctgttgaacgccctgcaactgacctctaaatttcagtccttcgagaaaatgggtaaacagaatgggtttttgttctacgttcccgcgtggaacacatcgaaaattgatccagttacagggtttgtcaacctttttgatacacgctatgcaagcgtggaaaaaagtaaagccttcttcaccaagtttcagtccatctgctacaatgaagccaaagactattttgaactggtctttgattacaacgactttacggagaaagcaaaagaaacccgttccgagtggacgctttgcacgtatggggaacgcattgtgtcgtttcgtaacgctgagaagaaccaccagtgggactctaagacgatccaccttacgacggaattcaaaaatctttttggagaattacatggtaatgacgttaaagagtatattctggagcagaattcggttgaattctttaagagcctgatctatttgttgaagatcacccttcagatgcgcaattccattacaggtacagatattgactatttggtcagtccggtagcggacgaagcggggaatttttatgattcccgcaaagcagatactagtcttcctaaggacgctgatgcaaacggagcatataacatcgcccgtaaaggacttatgttaatgcatcgtattcaaaatgcagaggatcttaagaaagtgaatcttgccatcagtaatcgcgattggttacgcaacgcacagggcctggacaagtga

SEQ ID NO: 817 - DNA, 3594 bp, synthetic construct
  misc_feature 1..3594: note = Description of Artificial Sequence: Synthetic polynucleotide
  source 1..3594: mol_type = other DNA
atgctgtcgaacttcacgaatcaatatcagcttagtaaaacgttacgcttcgagttaaaaccagttggtgatactttaaaacatattgagaagagtggcctgattgcacaggacgagattcgctctcaggagtaccaggaagttaagacaatcattgataaatatcacaaggctttcattgatgaggcattacaaaacgttgtactttctaacctggaagagtatgaggctttgttttttgaacgtaaccgcgacgagaaggctttcgagaagctgcaagcagtgttacgcaaagagatcgtcgcgcattttaagcaacacccgcagtataagacattgttcaagaaagaattaatcaaagcagacctgaaaaattggcaggagctttctgacgctgagaaggagctggtcagccactttgacaatttcactacatatttcacgggattccatgagaaccgtgctaacatgtacacggatgaagccaaacatagttctattgcttaccgtatcattcacgagaatctgccaatctttttgactaacaaaaagttgttcgagacgatcaagcaaaaggcaccgcacctggcgcaagagacccaagacgccttgttagagtatttgtccggagccatcgtcgaggacatgtttgaattgtcttatttcaatcatcttcttagtcaaacccacatcgatttgtataatcaaatgattggtggcgtaaagcaggattcgttaaaaatccagggtcttaatgaaaaaatcaacctgtatcgtcaagcgaacggattatctaaacgcgaacttccgaatctgaaaccacttcataagcaaatcttgtctgaccgcgagactctgagctggttacccgagtcgttcgagagcgatgaagagttgatgcagggggtacaggcatacttcgagtcggaggtcttagcatttgagtgctgcgacggaaaggtgaatcttctggaaaaattaccggagttgcttcaccaaactcaggactacgacttttccaaagtctatttcaaaaacgacttggctttgaccgcagcgagccaagcaattttcaaggattatcgtattatcaaggaggcactttgggaagtcaacaagcccaaaaagagtaaagacctggtcgctgatgaggaaaaatttttcaataagaagaatagctacttctctattgagcaaattgacggggctcttaactccgcgcagctttcagcgaacatgatgcattattttcagtcggagtctactaaagtaatcgagcagatccagttaacctacaacgactggaagcgcaacagtagtaacaaggagttacttaaggcgtttttggatgccttattatcctaccaacgtctgttaaagcccttaaacgcacctaacgacctggaaaaggatgtagcattctacgcttacttcgatgcttatttcaccagcctttgtggagttgtgaagctgtacgataaagtacgtaattttatgactaagaaaccgtacagtttggagaagtttaagctgaattttgaaaacagcacgctgttggatggttgggacgtcaacaaggagtcagacaacaccgccatcttatttcgcaaggaaggtttatattacctgggtattatgaataagaagtacaacaaagtattccgcaacattagttctagccaagatgagggctatcaaaagatcgattacaaactgttgccgggtgcaaacaaaatgcttccaaaggtctttttctctgataaaaacaaggaatactttaaacctaatgctaaacttttagaacgctacaaagccggcgagcacaaaaagggcgacaacttcgatttagacttctgccacgagttgatcgacttcttcaagacgtctattgagaaacaccaagattggaaacatttcgcatatcaattttcgcctactgagagttacgaagatctgtccggtttctaccgcgaagtcgagcaacagggctacaaaattagctacaaaaatattgcggcgtctttcatcgacacgctggtggctgaaggaaagctgtatttttttcaaatctataacaaggacttctctccatatagcaaaggtaccccgaacatgcatacactgtactggcgcgctcttttcgacgaaaagaaccttgcagacgtaatctacaagctgaacggtcaagctgaaatttttttccgtaagaagtcaatcgaatacagccaagaaaaattacagaaaggccaccatcatgaaatgttgaaagataaatttgcatacccaattatcaaagatcgtcgcttcgctttcgataaattccagttccatgttcccattaccctgaactttaaggcggaggggaacgaaaacattacccctaaaaccttcgagtacattcgttccaacccggacaatatcaaggttatcggcatcgaccgcggtgaacgccatctgttatatcttagcttgatcgatgcggaaggtaagattgtcgagcaattcacccttaaccagatcattaactcatataatggtaaggaccacgtaatcgactatcatgcaaagcttgacgccaaggagaaggatcgcgacaaggcgcgtaaagaatggggcacagttgagaacattaaggagctgaaagaaggttacttaagtcatgtcattcacaaaattgcaacactgatcatcgaacatggtgccgtggtcgcaatggaggacctgaattttggattcaagcgcggtcgctttaaggtggaaaaacaagtctatcaaaaatttgaaaaagctttaattgataaacttaactaccttgttgacaagaaaaaggagcctcacaaattaggtgggcttctgaatgcgctgcaattaacgtccaagtttcaatccttcgaaaaaatgggaaaacagaatggttttttattctatgtcccggcttggaacacaagtaaaattgatcctgttaccggcttcgtgaatttgttcgatacccgctacgcgagcgtagaaaaatctaaagcatttttcaccaaatttcagagtatctgctataatgaggcaaaggattattttgaattggttttcgactataatgattttacagaaaaagctaaagagactcgttctgagtggaccttgtgtacgtatggtgaacgtatcgtaagcttccgcaacgctgaaaaaaatcaccagtgggactctaaaacgattcatttgacaaccgagtttaaaaaccttttcggagaattgcacggtaacgacgttaaggaatatatcttagaacaaaattcggtcgaatttttcaagtcccttatctatcttttgaaaatcactcttcagatgcgcaattcgatcacagggaccgatatcgattatcttgtttcacctgtggctgacgaagcaggcaacttttacgacagccgcaaggccgacactagcttaccgaaagacgcagatgctaacggcgcctacaatatcgctcgcaaaggtcttatgcttatgcatcgcattcaaaacgctgaggacttaaagaaggttaatttagcgatttctaatcgtgactggttgcgtaacgcgcaagggctggacaagtga

SEQ ID NO: 818 - DNA, 3759 bp, Prevotella ruminicola
  source 1..3759: mol_type = genomic DNA
atgatcgacttaaaacaatttattggcatatatcctgtatcaaagaccttgcgctttgagttgagacctgttggtaagacacaagagtggatagaaaagaatagagttcttgaaggagatgaacagaaggccgcagattaccctgtggttaagaaacttatagatgattaccataaagtatgcattcacgactccttaaatcacgttcacttcgattgggagcctttgaaagatgctatcgaaattttccagaaaacaaagagtgacgaggctaagaaacgacttgaggcagagcaggctatgatgcgtaaaaagatagctgctgcaatcaaggactttaagcatttcaaggagttgacagcggcaactcccagcgatttgattacctctgttcttcctgaattcagcgatgatgggtcgttaaaatcctttcgcggttttgcaacctatttcagtgggttccaagagaatagaaataatatttatagtcaggaggctattagtacgggagtaccttatagactggttcatgataactttcctaagttcctttctgatttggaagtgtttgaaaggatcaagagcacttgtccagaagttatcaatcaggcatcagcagagttacagcccttcttagaaggagtgatgatagacgacattttctcgctcgacttctataattctctgttgactcagaatggtatagatttctttaatcaagtaataggcggcgtaagcgagaaggacaagcagaagtatcgtggtattaacgagttctcaaacctttatcgtcaacagcataaagaaattgcagcatcgaagaaggctatgacaatgataccattattcaagcagatattatctgatcgtgatactttatcttatattcctgctcagataagaacagaagacgaattggtatcttctatcactcagttctatgaccatatcacccatttcgagcatgatggaaaaaccatcaatgtgttatcagaaatagtggctctgttgggtaagttggatacttacgatcctaatggtatttgtataaccgcccgcaagttgacagatatttcacaaaaggtatatggaaagtggagtgttatcgaggaaaaaatgaaagagaaggctatccagcagtatggcgatatatctgtagccaagaataagaaaaaggtagatgcttttctttcgcgtaaggcctatagcttgtctgatttgtgctttgatgaagaaattagtttctcacgctattactctgaattaccccaaactttaaatgcaattagcggctattggctgcagtttaacgagtggtgtaagagtgatgaaaagcagaagttcctgaacaaccaaacaggcacggaggtggtgaaaagtcttttggatgccatgatggaattattccataagtgctctgtcctggtaatgccggaagagtacgaggtagacaagagtttctataatgaattcctccctctctatgaagaacttgatacgctcttcctgttatataacaaggtgagaaattatctcactcaaaagccatccgacgttaagaagtttaagttgaattttgagtcgccttcattggctagtggatgggaccagaataaggaaatgaagaataatgcgattcttcttttcaaagatggtaagtcgtatttaggcgtattaaatgcaaagaataaagccaagataaaagatgctaagggcgatgtgtcgtcttcttcctataaaaagatgatttacaagcttctatctgatccttcaaaggatttacctcataaaatattcgcaaaaggaaatcttgatttctacaagccttcagagtatattttagaaggaagagagttgggtaaatacaagaaaggtccaaactttgacaagaagttccttcatgactttatcgatttctacaaggccgcaattagtattgatccagattggagcaaattcaacttccagtattcccctacagaatcatacgatgatattggcatgttctttagcgaaatcaagaagcaggcttacaagattcgttttactgatatctcagaagctcaggtgaacgagtgggttgataatggccagttatatctgttccagctctataataaggactatgccgaaggtgcgcatggccgtaagaatctgcatacactctactgggagaatctgtttacagacgagaacctcagcaacctagtgcttaaattgaatggtcaggctgaattgttctgtcgtcctcaaagtatcaagaaacctgtttcacacaagattggttcgaagatgctgaatcgcagggataagagcggaatgcccataccagaatctatttatcgcagcctgtatcagtattataatggcaagaaaaaggaaagtgaactgacagttgctgaaaaacagtatatagatcaggtgattgtgaaggatgtcactcacgaaattatcaaagaccgcagatataccagacaggagtacttcttccatgtgccactgacattcaatgccaatgctgatggtaatgagtatatcaacgaacatgtactgaactatctgaaagataatcctgacgtaaatattataggtatcgaccgtggtgagcgtcatctgatttaccttacattgatcaatcagcgtggagaaattctaaagcagaagacttttaacgtggtgaatagctataactatcaggctaagttggaacaacgagaaaaggaacgtgatgaggctcgtaagagttgggatagtgtaggtaagataaaagacctgaaagagggtttcctctctgccgttatccatgagataaccaatatgatgattgaaaacaatgccatcgtggtgcttgaggacttgaatttcggattcaaacgtggacgcttcaaggtggagcgccaggtgtatcagaagtttgagaagatgctgattgataaactgaattatctgtcattcaaggatcgcgaggctggcgaagagggtggtatactcagaggctaccagatggcacagaagtttataagtttccagcgtcttggtaagcagagtggcttcttgttctacatcccagctgcttatacctcaaagatagatcctgtatcaggtttcgttaatcatttcaacttcagcgatatcactaatgccgagaagcgtaaggacttcttgatgaagatggatcgcattgagatgaagaatggaaatattgaatttacattcgactatcgcaagtttaagacattccagactgactatcagaacgtttggactgttagcactttcggaaagcgaattgtgatgcgaatagacgaaaaaggatataaaaagatggtagattacgaaccaacaaacgatattatcaaagcttttaagaataaaggcatcctgttgtcggaaggttctgatttaaaagctctgattgcagagattgaagccaacgcaactaatgccggcttctatagcacactgctctatgctttccaaaaaactctgcagatgcgtaatagtaatgctgtaacggaagaagattatatcctctctcctgtagctaaagatggacatcaattctgtagtactgatgaggcaaacaagggcaaagatgctcaaggcaactgggtatcaaaactgcctgtagatgctgatgctaatggtgcatatcacatcgctttaaagggactttatttgctcagaaatcctgaaacaaagaaaatagaaaacgaaaaatggctccagtttatggttgagaaaccgtatttggagtaa

SEQ ID NO: 819 - DNA, 3759 bp, synthetic construct
  misc_feature 1..3759: note = Description of Artificial Sequence: Synthetic polynucleotide
  source 1..3759: mol_type = other DNA
atgattgatttaaagcaattcatcggaatctatccagtgtccaagaccttgcgttttgaattacgccctgtagggaagacccaagagtggatcgagaagaatcgtgtgttggaaggcgacgagcaaaaagctgcagattatccggtagtaaaaaaattaatcgatgactaccataaagtttgcattcatgacagccttaatcatgtgcacttcgattgggagccgttgaaggatgccatcgaaatcttccaaaaaacgaaaagcgacgaggccaaaaagcgtttagaggccgagcaagcaatgatgcgtaaaaaaatcgcggctgcaattaaggattttaagcactttaaagaattaactgcagcaacgccttcggatcttatcacctcggtgttaccagagttttcagacgatggaagtttaaagtcatttcgtgggttcgctacatacttttcgggctttcaggaaaatcgtaacaatatttacagtcaggaagcaatctcaactggagttccgtaccgtttagtgcatgacaactttccaaagttcctgtccgacctggaagtctttgagcgcatcaagtcaacttgtccggaagttattaaccaggccagtgcggaattacaaccgttcttggaaggggttatgattgatgatattttcagtcttgatttctataacagcttattgacccagaatggcattgatttctttaatcaagtcatcggaggtgttagcgaaaaagataaacaaaagtaccgtggaattaacgaattctcaaacttatatcgccagcaacacaaagagattgcagctagtaagaaggctatgactatgatccccctgttcaagcaaattttgtccgatcgtgacacgttgtcgtacattcctgcccagatccgcaccgaagacgagcttgtgtctagcatcacgcaattttacgaccacatcacccatttcgaacatgacgggaagaccattaacgtgttgtcagagattgttgcacttcttgggaaactggatacatacgaccctaatggtatctgtatcactgcccgcaagttgaccgatatctcgcagaaggtctacggtaaatggtctgtcattgaggaaaagatgaaagaaaaagcgattcaacagtacggtgacatttccgtggcgaaaaataaaaaaaaagtcgacgccttcttatcacgcaaagcttactctctgtctgatttatgcttcgatgaggaaatctcgttctcacgttattactcggagttaccccaaacgcttaacgctatctcgggatactggctgcagtttaatgagtggtgtaagtccgacgaaaagcaaaaatttttaaataatcagacagggactgaagtagtgaagtcccttttggacgcaatgatggagttgtttcacaagtgctcagtcttggtaatgccagaagaatacgaggtcgacaaatcattctacaatgagtttttacccctttacgaagaactggacactttattcctgttgtataataaggttcgcaattacctgacacagaaaccgtctgacgtgaaaaaattcaaattgaactttgagagtccaagtttggctagcggatgggaccagaataaggagatgaagaataatgcgattttgttattcaaggatggaaagtcgtatcttggtgtcttaaatgctaaaaataaggccaagattaaagacgccaagggggacgtttctagttcctcatacaaaaagatgatttacaaacttctgtctgatccgagtaaggatctgccccataagattttcgccaaaggcaatctggacttttacaagccaagtgagtatattttagagggacgcgagttaggtaaatataaaaaaggacccaacttcgataaaaagttccttcatgatttcatcgacttctacaaagcagccatctcgatcgacccggattggagcaaattcaactttcaatactcgcctaccgaatcctatgatgacattggcatgtttttctccgaaatcaagaaacaagcttacaaaattcgctttacggacatttcagaagcacaggttaatgaatgggtagacaacggtcagttgtatttattccaattgtataataaagattatgcggagggtgctcatgggcgtaagaaccttcatacattgtattgggagaatctgttcacagacgagaatcttagcaatttggtgttgaagttgaatggccaagctgagttgttttgtcgtccccaaagcattaaaaaaccagtttcgcacaagattggatcgaaaatgcttaaccgtcgcgataagtccggaatgcctatcccggaaagcatttatcgctccctttaccaatactacaatggcaaaaaaaaagagtcggaacttaccgtcgctgaaaagcaatacattgaccaggtaatcgtaaaggatgtgacgcacgaaatcatcaaagaccgccgttatacgcgtcaagagtacttctttcacgtaccattaaccttcaatgccaacgcggatgggaatgagtatattaatgagcatgtgcttaactaccttaaggacaacccggacgtaaacatcattggaattgaccgtggggaacgtcatttaatttatttaaccttgattaatcaacgtggggagatcctgaaacagaagacgttcaacgttgtcaatagctacaattatcaagcaaaactggagcagcgtgagaaagagcgtgacgaggctcgcaagtcgtgggattcagtcggcaagattaaagacttaaaagagggatttttgtcagccgtaattcacgaaattaccaacatgatgatcgaaaataatgccattgtcgtgcttgaggatttgaacttcggtttcaagcgcggacgtttcaaagtagaacgtcaggtgtatcaaaagtttgaaaaaatgctgatcgataaactgaattatttatcgttcaaagaccgcgaagcgggagaagaaggtggaattctgcgcggatatcagatggcccagaaattcattagttttcaacgcttagggaagcaatctggctttctgttttacatcccagcggcctacacatctaaaatcgatcccgtatccgggttcgtcaaccattttaatttttccgacatcacgaacgcggagaagcgcaaggacttcctgatgaaaatggatcgtatcgaaatgaaaaatggaaatatcgagttcacctttgattatcgcaagttcaaaacctttcagacagattaccaaaacgtatggacagtcagtacctttggaaaacgtatcgtcatgcgcatcgatgaaaagggatataagaagatggttgattatgaaccgacgaatgatatcatcaaagcatttaaaaacaaaggcatcttactttcagagggttccgacttaaaggcactgatcgctgaaattgaggccaacgccacaaacgcgggtttttattccacattactgtatgcgttccaaaaaacgcttcagatgcgcaactcgaatgcagttaccgaggaggattacatcctttctcccgtggctaaagacggccaccagttttgtagcacggatgaagccaataagggcaaagacgcccagggaaactgggtatcaaaacttccagtagatgccgatgctaacggcgcgtatcatattgcactgaagggattatatttgttgcgcaacccagaaaccaaaaagatcgaaaatgagaagtggttgcagttcatggtggaaaagccctatttggagtaa

SEQ ID NO: 820 - DNA, 3759 bp, synthetic construct
  misc_feature 1..3759: note = Description of Artificial Sequence: Synthetic polynucleotide
  source 1..3759: mol_type = other DNA
atgattgatctgaagcaattcattgggatttacccggtgtcaaaaacgctgcgttttgagcttcgcccggtcggtaaaacacaggagtggatcgagaaaaatcgtgttttagaaggagacgagcaaaaagccgcagattaccccgtagtcaagaagcttattgatgattaccacaaggtctgtatccacgacagccttaatcatgtccactttgactgggagcccctgaaggacgctattgaaatctttcaaaaaaccaagagcgacgaagccaagaagcgccttgaagcggagcaggctatgatgcgcaaaaagattgctgcggcgattaaggatttcaagcatttcaaagagctgaccgcggctactcctagcgatctgatcacctctgtactgcctgaattctcagacgatggctcattaaagtcctttcgtggcttcgctacttacttcagtggatttcaagagaaccgtaacaacatctactcgcaggaggccatttctaccggggtgccttatcgtcttgttcacgataatttcccaaaatttctgtcggatttagaggtttttgaacgtatcaaaagtacgtgcccagaggtgattaaccaagcttctgcggaactgcaacctttccttgagggcgtcatgatcgatgatattttcagcttagacttctataactcactgttaacacagaatggaatcgacttctttaaccaagtgattggtggcgtctcagaaaaggacaaacaaaaatatcgcggtattaatgagtttagtaatttgtaccgccagcagcacaaagaaatcgctgcgtctaaaaaagccatgacgatgattccgttgttcaaacaaatcctgtctgatcgtgacactttatcttatatcccagcgcaaattcgcactgaggacgaattggtcagctccatcacgcagttctacgatcatatcacacacttcgaacatgacggtaagaccatcaatgtgttgtccgaaatcgtggctttgctgggtaagctggacacctacgaccctaatggcatctgcattacagctcgtaagctgaccgacatttctcaaaaggtctacggtaagtggagtgtcatcgaggaaaaaatgaaggaaaaagccattcagcagtatggtgatatttctgtggctaaaaacaagaagaaagtcgatgcctttctgtcacgtaaggcttactctttgtccgatctttgcttcgacgaggaaatttcattctcgcgctactattccgaattacctcagaccctgaatgcaatttccggctattggttacagttcaatgagtggtgcaaaagtgacgaaaaacagaagtttttaaacaatcagacagggacggaagtggtcaagtccttgttagatgcaatgatggagttgtttcataagtgttctgtgttggttatgccggaagagtatgaggttgataaatccttttacaatgagttccttccgctgtacgaggagctggacacgttgtttctgttatataacaaggtacgcaactaccttactcaaaagccgtccgatgttaagaagttcaagctgaatttcgaatcaccttcccttgctagtggatgggaccagaacaaggagatgaaaaataatgccatcttattatttaaggacggtaagtcttacttgggagtgcttaatgctaaaaacaaagcgaagattaaggacgcgaagggggatgtctcatcaagctcttacaagaaaatgatttacaagttactgtccgacccaagcaaagatcttccccataagatcttcgcaaaaggaaatttagatttttataagccgtcagagtacattcttgaagggcgcgagctgggaaagtataagaaggggccgaattttgacaaaaagtttcttcatgatttcattgacttctacaaagcggcaatctccattgatcctgactggagcaaatttaacttccagtactctcctacagaaagttatgacgacattgggatgttcttctcagaaattaaaaaacaggcatataaaatccgttttacagacatttcagaggcacaggttaatgagtgggtcgataatggccaattgtacttgtttcaactttacaataaagattatgcagaaggtgcacacggccgcaagaaccttcatacgctgtactgggagaatctttttacagatgaaaacttgtcaaatcttgtccttaaattaaacggacaagctgagttgttctgtcgtcctcagtccatcaaaaaaccagtctcacataagatcggatcgaagatgttaaatcgccgtgataaatccggcatgccgatccctgagtcgatttaccgctccttgtatcagtattataacggtaaaaaaaaggagtcagagttaacagttgcagagaagcaatatatcgatcaagtcattgtcaaagacgtgacacacgagatcatcaaagaccgccgctatacgcgtcaggaatatttctttcatgtccctttgacctttaacgccaatgcggacggaaacgagtatattaacgagcacgtcctgaattatttaaaagacaacccagatgtcaacattatcgggattgaccgcggagagcgccacctgatttatttaactcttatcaatcaacgcggtgagattctgaagcagaagacgtttaatgttgtgaatagctataattatcaggcaaaattggaacagcgcgagaaggaacgtgacgaggctcgtaagagttgggactcggtaggaaagattaaagatttgaaagaaggctttttatctgcagtgattcatgagattacgaacatgatgattgagaataatgctatcgttgttttagaagacttaaattttggatttaagcgtgggcgtttcaaggtcgagcgccaagtttatcagaaatttgaaaagatgttaattgacaagttgaactacctttccttcaaagatcgtgaagcaggtgaggagggtggcattttacgcgggtatcagatggctcagaagttcatctctttccaacgcttggggaaacaaagcgggttcttgttctatattccggcagcttacacatctaagattgatccggtatctggtttcgtaaaccattttaactttagtgatattactaatgccgagaaacgtaaagactttcttatgaaaatggatcgcatcgagatgaagaatggtaatattgagttcacctttgactaccgcaagttcaagacgtttcagacggattatcaaaatgtctggactgttagtacatttggcaaacgtattgtaatgcgcatcgacgagaaggggtataagaagatggtggattatgagccgacaaatgacatcatcaaggcttttaaaaacaaaggcattcttttgtctgaaggatccgatttgaaagcattaatcgccgaaatcgaagcaaatgccaccaatgcgggattctactccacattattgtatgccttccaaaaaacattacagatgcgtaactcgaatgcagtaacggaagaagactatattcttagtcccgtagccaaggacggacaccaattttgcagcaccgatgaggctaacaaaggtaaggacgcgcaagggaactgggtcagtaagttaccggtggatgccgacgctaatggagcgtatcatattgctttaaaaggattatacttgttacgcaatcccgaaaccaagaaaattgaaaacgaaaaatggttacagttcatggtagagaagccgtaccttgagtaa

SEQ ID NO: 821 - DNA, 3759 bp, synthetic construct
  misc_feature 1..3759: note = Description of Artificial Sequence: Synthetic polynucleotide
  source 1..3759: mol_type = other DNA
atgatcgaccttaaacagtttattggtatttatccggtgtcgaaaacgcttcgttttgagttgcgtcctgttggtaaaactcaagaatggattgagaagaaccgcgttttagagggtgatgaacaaaaggcggccgattatcctgtagtaaagaaactgatcgatgactatcacaaggtgtgtattcatgacagtttaaaccatgtacatttcgattgggagcctttgaaagatgcgattgagattttccagaagacaaagtcagacgaggcgaagaaacgcttggaagcagagcaggctatgatgcgcaagaagatcgccgccgcgattaaagactttaaacattttaaagagttaactgctgctaccccttccgatctgatcacgtcagtgttgcccgaattttctgacgacggatccttgaaatcgtttcgcggttttgcaacatatttctctggcttccaggaaaatcgtaacaatatttattcccaagaagctatctcaacgggtgttccttatcgtcttgtccatgacaactttccaaagtttctgagtgatttagaagtgttcgagcgcatcaagtcaacgtgcccagaagtgatcaaccaggcctccgcggagttgcaaccattcttagagggagtaatgattgacgatattttctcattagacttctataattcgctgttgacccaaaatggcatcgacttcttcaaccaggtcatcggaggtgtgagtgaaaaagacaagcagaagtatcgtggaattaatgagttctcaaatctgtatcgccagcaacacaaagagattgccgcaagtaagaaggctatgacaatgatccccttgtttaagcagatcttatccgaccgtgacacactttcttacattcctgcccaaattcgtacagaagacgaattggtatctagcatcacgcaattctacgaccacatcactcacttcgaacacgacggtaaaacgatcaatgtattaagtgagatcgttgcgctgttgggaaaacttgacacttacgaccctaacggcatttgcattacggcacgtaaacttaccgacatctcgcaaaaggtgtatgggaaatggtccgtcatcgaggaaaaaatgaaggaaaaggcgattcagcagtatggagacatctctgtggctaagaataagaaaaaggttgacgcttttttgtcccgcaaggcgtactcgttgtctgatctgtgtttcgatgaagagatctccttctcacgttattattcggagctgccccaaacgttgaatgcaatttctgggtattggttgcagttcaacgagtggtgtaagagcgacgaaaagcagaaatttcttaacaatcagacaggtactgaggtcgttaaaagcttattagacgcgatgatggaactgttccacaaatgttcggtcttagtaatgcctgaggaatatgaggtagacaaatcattttataatgaatttcttcctctttatgaagaattggataccttatttttgctgtataataaagttcgtaattacctgacgcagaagccctctgacgtaaagaaattcaaattgaattttgaatcgccttccttagcatcggggtgggatcaaaataaagaaatgaaaaacaacgcaatcttattatttaaagacggaaagtcatacttgggcgtgttaaacgccaagaataaggccaaaattaaagatgcaaagggcgatgtctcatcgtcgtcctacaagaagatgatttataaacttctttctgatcctagcaaggatttaccgcataaaattttcgcaaaggggaacttagatttctataaaccctcggaatatattttggaaggccgtgagttgggtaaatataaaaagggacccaattttgataaaaaattcctgcatgatttcatcgacttctacaaggcagctatttccatcgacccagactggtccaaattcaacttccaatactcgccaacggagtcttacgacgatatcgggatgtttttctcggagattaagaaacaggcctataagatccgctttacggatatttccgaagcacaagttaatgagtgggtggacaacgggcagctttatcttttccagttatacaacaaggactacgcggaaggggcccacggccgtaagaacttgcatactttatattgggagaatttgtttaccgatgagaacctgagtaatttggtactgaagctgaatggccaagcagaactgttttgccgtccgcaaagtattaagaagccagtgtcgcacaaaattggatctaagatgctgaatcgtcgcgataagtcaggaatgcctattccagagtccatctatcgttcgctttaccagtactacaatggcaaaaagaaagagtctgaattaaccgtggcggaaaagcagtatattgatcaagtaattgttaaggatgttacacacgagattattaaggatcgccgctacacacgtcaggaatatttctttcatgtcccacttacgttcaatgctaacgcagatggcaacgagtatattaacgagcacgtgttgaactatcttaaggataatccggatgtgaacatcattgggattgatcgtggtgagcgtcatttgatctatctgaccttgattaatcaacgtggtgaaatcttgaagcagaagacattcaacgttgttaacagttacaattaccaggcgaaacttgagcagcgtgaaaaggaacgtgacgaggcacgtaagtcgtgggatagtgttggaaagattaaagacttgaaggaaggttttttgtcggcggtaattcacgagatcacgaatatgatgattgagaacaacgcaatcgtagtactggaagatctgaattttgggtttaaacgcgggcgctttaaggtggaacgccaagtgtaccagaaatttgagaagatgcttattgataaactgaactatttatcgtttaaggaccgcgaagctggagaagaaggcggcattctgcgtggataccaaatggcgcaaaaatttatctcgttccagcgtctgggcaaacaatccggcttccttttctacattcccgctgcttacacatcaaagattgaccctgtctcgggtttcgtaaatcattttaacttctcagatattacgaacgctgagaaacgcaaagactttttaatgaagatggaccgcattgaaatgaaaaacggtaatatcgagttcacctttgattaccgcaagttcaagacattccagaccgactaccagaacgtctggacagtatccacttttgggaagcgtattgtaatgcgtatcgacgaaaagggctataaaaaaatggtcgattatgaaccgacaaacgacatcattaaggcttttaagaataagggtattttactgagtgagggctctgatttgaaggctcttattgctgaaattgaggccaacgctacgaacgctggattttatagtacacttctttacgcgttccaaaaaactcttcagatgcgcaacagcaacgcggtgacagaggaagactatattttaagtccggtagcgaaagatggacatcagttctgttctacagacgaggccaataagggaaaggacgctcagggtaattgggtttcgaagctgccggttgacgccgatgctaacggcgcgtatcacatcgctttaaagggattatatcttctgcgtaatcccgagacaaagaagatcgaaaatgaaaaatggttacaatttatggttgaaaaaccttacttggaataa

SEQ ID NO: 822 - DNA, 3864 bp, Clostridium sp.
  source 1..3864: mol_type = genomic DNA
atgtcgtataatagagaaaaaatggaggagaaagaattgggtaaaaatcaaaattttcaggaatttattggggtatcaccacttcaaaagactttaagaaacgaattgatcccaacagaaacaacaaagaagaatattgctcagcttgatcttttgactgaggatgaagtgcgtgcgcaaaatcgagagaagctgaaagaaatgatggatgactactaccgggatgtgattgatagtacgttacggggggaattattgattgattggagctatttattttcgtgcatgcgaaaccatctaagtgagaattccaaagagtcaaaacgggaattggaacgaacacaggattctgttcgttcacaaatccatgataagtttgctgaacgagcggattttaaggatatgtttggagcatcgataataacaaaattacttccgacatatataaagcaaaattcaaaatattccgagcggtatgacgagagcgtgaaaattatgaaactgtatggaaaattcacaacatcgttgaccgattactttgagacaagaaagaatatcttttctaaagagaaaatatcctctgccgttggatatcgaatcgtagaggaaaatgctgagattttcctgcagaatcagaatgcttacgacagaatctgtaagatagcgggactggatttacatggattggataatgaaataacagcatatgttgatggaaaaacattaaaagaagtatgttccgatgaaggatttgcaaaggtgattacacaaggagggattgatcgctacaacgaggcaattggtgcggtaaatcaatatatgaatctgttatgccagaagaataaggcattaaaaccgggacaatttaagatgaagcggctacataaacagattctttgcaaaggaacaacctctttcgatattccaaagaagtttgaaaatgataaacaggtgtatgacgcagttaattcttttacagagatagtaacgaagaataatgatttgaagcgactgttaaatattacacagaatgcaaatgattatgacatgaataaaatctatgtagtagccgatgcatatagtatgatttcacagtttatcagtaaaaaatggaatctgattgaagaatgcttgctggattattatagcgataatttgccgggaaaaggaaatgcgaaagaaaacaaagttaaaaaggcggtaaaggaagaaacgtatcgcagtgtttcacagttgaatgaagttattgagaaatattatgtggaaaagaccggacagtcagtatggaaagtggaaagttatatttctagtctggcagaaatgattaagctggaattgtgccacgagatagataacgatgagaagcataatctgattgaagatgatgagaagatatccgagattaaggaactgttggatatgtacatggatgtatttcatattataaaagtgttccgggtgaatgaagtattgaatttcgatgaaaccttttattcggagatggatgagatctatcaggatatgcaggaaatcgttccattatacaatcatgttcgaaactatgttacacagaaaccatataagcaggagaaatatcgtttatatttccacactccaacattggcaaatggctggtccaagagtaaggaatatgacaacaacgcaattatattggtgcgagaagataaatattatttaggtattctgaatgcgaaaaagaaaccatcgaaagaaattatggcgggcaaagaggattgttcagaacatgcatatgcaaagatgaattattatttgttgccgggcgcgaacaagatgcttccaaaagtatttttatctaagaaaggaatacaggactatcacccatcatcatatattgttgaaggatataatgaaaagaaacatattaaaggttccaagaattttgatatccggttttgtagggatttgattgactacttcaaggaatgcattaaaaaacatccggattggaataagtttaactttgaattttctgcgacagaaacatatgaggatatcagtgtcttttatcgcgaagttgaaaagcaaggatatcgcgtagagtggacgtatatcaatagtgaagatattcagaaactggaagaagatggacagttgtttttatttcagatatataacaaagattttgctgtgggaagtacaggtaaaccaaatcttcatacattgtatctgaaaaatctgttcagcgaagaaaatttgcgggacattgtattaaaactaaatggggaagcagaaatattcttccgtaaatcaagtgttcaaaaaccggtgattcataagtgcggcagtattttagtcaatcgtacctatgagattaccgagagtggaacaacacgggtacaatcaattccggaaagtgaatacatggaattatatcgctactttaatagtgaaaagcagatagaattatcagatgaggcaaaaaaatatttggacaaggtgcaatgtaataaggcaaagacagatattgtgaaagactaccgatacaccatggacaagttttttattcatcttccgattacgattaattttaaggttgataagggtaacaatgttaatgccattgcacagcaatatattgcagagcaggaagatttgcatgtgataggaatcgatagaggagaacggaatctgatttacgtttctgtaattgacatgtatggcagaattttagagcagaaatcctttaaccttgtggaacaggtatcgtcgcagggaacgaagcgatattacgattacaaagaaaaattacagaaccgggaagaggaacgggataaagcaagaaagagttggaagacaatcggcaagattaaggaattaaaagaggggtatctgtcgtcagtaattcatgagattgcacagatggtcgtaaagtataacgcaatcattgcaatggaagatttgaattatggatttaagcggggaagattcaaagtagagcgccaggtatatcagaaatttgaaacgatgttgatcagtaagttgaattatctggcagataaatctcaggctgtggatgaaccgggaggtatattacggggatatcagatgacttatgtgccggataatattaagaatgttggaagacaatgtggaataatcttttatgtgccggcagcatatacctccaagattgatccgacaaccggatttatcaatgcatttaagcgggatgtggtatcaacaaatgatgcaaaagagaatttcttgatgaagtttgattctattcagtacgatatagaaaaaggcttatttaagttttcatttgattacaaaaattttgccacacataaacttacacttgcgaagacaaaatgggacgtatatacaaatggaactcgaatacaaaacatgaaagttgaaggacattggctttcaatggaagttgaacttacaacgaaaatgaaagagttgctggatgactcgcatattccatatgaagaaggacagaatatattggatgatttgcgggagatgaaagatataacaaccattgtgaatggtatattggaaatcttctggttgacagtccagcttcggaatagcaggatagataatccggattacgatagaattatctcaccggtactgaataatgatggagaattttttgattctgatgaatataattcatatattgatgcgcaaaaggcaccgttaccgatagatgccgatgcaaatggcgcattttgcattgcattaaaaggaatgtatactgccaatcagatcaaagaaaactgggttgaaggggagaaacttccggcggattgcttgaagatcgaacatgcgagttggttagcatttatgcaaggagaaaggggatag

SEQ ID NO: 823 - DNA, 3864 bp, synthetic construct
  misc_feature 1..3864: note = Description of Artificial Sequence: Synthetic polynucleotide
  source 1..3864: mol_type = other DNA
atgtcgtataaccgtgagaagatggaggaaaaagagctgggtaagaaccaaaatttccaagaatttatcggtgtaagtccactgcaaaagacgcttcgcaatgagttaattccgactgagacaacgaagaaaaatattgctcaacttgacttactgactgaggacgaggtccgtgcgcagaaccgtgaaaagctgaaagaaatgatggatgactattaccgcgatgtcattgattcaacgcttcgtggcgaattgttaattgattggagttacctgttctcttgcatgcgcaaccatttaagcgaaaactctaaggagtcgaagcgtgaacttgaacgcactcaggacagtgttcgcagtcagatccacgataaattcgcagaacgtgctgatttcaaagatatgttcggagccagtatcattacgaagttacttcctacttatattaagcagaattccaagtacagcgaacgttatgacgaaagcgtaaagatcatgaaattatatggaaagtttacaacgtcactgacggattattttgaaacgcgtaagaatatcttttctaaagaaaaaatcagctctgccgtgggataccgtatcgtggaagagaatgcggaaatctttctgcaaaatcaaaatgcctacgaccgcatttgcaaaatcgccggtcttgacttacatggcctggataacgaaatcacggcttacgttgacggaaaaactttgaaggaagtctgcagcgacgaaggtttcgccaaggtcattacacaagggggtatcgatcgttataatgaagccattggcgccgtcaaccagtacatgaacctgctttgccagaaaaacaaagcgttgaaaccgggacagtttaagatgaagcgtcttcataagcagatcttgtgcaagggcacgacgtcctttgacatccctaaaaagttcgagaatgataagcaagtctatgatgctgttaatagtttcacagagatcgtcactaagaataatgatttaaaacgtcttttgaacatcactcaaaacgctaatgactacgatatgaacaagatttatgtggtcgccgacgcatattcaatgatttctcagtttatctcgaagaaatggaatcttattgaggaatgtttattggactactattcggataacctgccaggtaaagggaatgctaaagagaataaggtcaagaaagctgtaaaggaagaaacctatcgttcggtcagccagcttaacgaggtgattgagaagtattatgttgaaaaaactggtcagtccgtttggaaagtcgagtcgtacatttcgtcgcttgccgaaatgattaagctggagctttgtcatgaaatcgacaatgacgagaagcataacttaatcgaggatgacgagaagatttcagagatcaaggagcttcttgatatgtacatggacgttttccacatcattaaggtatttcgtgtgaacgaagtacttaattttgatgaaactttttactctgaaatggacgagatctaccaagatatgcaggaaattgtgcctttatataatcacgtgcgcaactatgtcacacaaaagccctacaaacaagaaaagtaccgtttgtatttccacacccccacgttagccaacgggtggtccaaatctaaggaatatgataataacgcgatcatcctggtccgtgaagataagtactatttgggaatccttaatgcgaaaaaaaagccgtccaaagaaattatggcagggaaagaagattgctcagaacacgcttacgccaagatgaactactatttattacccggtgcaaataaaatgttgcctaaggtgtttttatccaagaagggtattcaggactaccatccgagctcgtatatcgtagagggctacaacgaaaagaagcacatcaaagggagcaaaaatttcgacattcgtttttgtcgtgatttgatcgactacttcaaagagtgcattaagaaacatccagattggaacaagttcaactttgagttttcagccacagaaacctatgaggacatctccgtgttctatcgcgaagtagaaaagcaaggataccgcgtagagtggacttacattaattccgaggacattcagaaattagaggaggacggccagttgtttctgtttcaaatctacaataaggattttgccgtgggatcgacgggcaaaccaaatttgcacactctgtacttaaagaatcttttctcggaggagaacctgcgtgacattgtacttaaattaaacggagaggccgaaatcttttttcgtaagtcgtctgtccaaaagccggtaatccacaaatgtgggtcgattttggtaaaccgtacatatgaaatcacggaatctggcactacgcgcgtgcaatccattccagagtccgagtatatggaattatatcgttatttcaactcggaaaagcagatcgagctgtctgatgaggccaaaaaatacttggataaagtacaatgcaataaagctaagaccgacattgttaaggactaccgctacacgatggataagttctttattcacttgccaattactattaacttcaaggtagacaaaggaaacaatgtaaacgcgattgcacagcaatatattgcagaacaggaggacctgcacgtcattggtattgaccgtggagagcgtaaccttatctacgtgtccgtcattgacatgtatggacgtatccttgaacaaaaatcatttaaccttgtcgagcaggttagtagccaggggacaaagcgctactatgattacaaagaaaagttgcagaaccgtgaagaagaacgtgacaaagcccgtaaaagttggaagaccattggaaagattaaggaattgaaggaaggttacttaagtagcgtgattcacgagattgcacaaatggtcgtgaaatataacgccattattgcaatggaggatcttaattatggtttcaagcgcggccgtttcaaagtggaacgccaggtctaccaaaagtttgaaactatgttgattagcaaattaaattatcttgctgacaaaagccaagcagtggacgaaccgggaggaatcctgcgtggttaccagatgacatacgtcccagacaacatcaagaacgtagggcgccagtgtgggattattttctacgtccccgccgcttatacatctaagattgaccctacaaccggctttattaacgcctttaagcgtgacgtagtaagcacgaacgatgctaaggagaattttctgatgaagttcgatagcatccaatacgacattgagaagggactttttaagttctcctttgattataagaactttgcaacccacaaacttacccttgcaaaaaccaagtgggacgtatatacgaatggcacgcgtatccagaatatgaaagttgaggggcactggctttctatggaagttgagttaactactaaaatgaaagagttgctggacgactcccacatcccatatgaagaaggtcagaatattctggacgatcttcgtgaaatgaaggatatcacgacgattgtaaatgggattttggagattttttggttaacagttcagttgcgtaacagccgtattgataaccctgactatgatcgcattatttcgccagttttgaacaatgacggtgagttcttcgactcagacgagtataacagttacattgacgcacaaaaggccccccttcctatcgacgcggatgccaatggcgctttctgcattgcactgaaaggaatgtacacggcgaaccaaatcaaggagaattgggtcgagggagagaaattaccagcggactgtcttaagattgagcacgcatcatggttagcctttatgcaaggggaacgtgggtag

SEQ ID NO: 824 - DNA, 3864 bp, synthetic construct
  misc_feature 1..3864: note = Description of Artificial Sequence: Synthetic polynucleotide
  source 1..3864: mol_type = other DNA
atgagttacaatcgtgaaaaaatggaggagaaggaactgggaaagaatcaaaacttccaggagtttatcggggtctcgcctttgcaaaagaccttacgtaacgaacttattccaaccgagacgacgaagaagaatatcgcacagttagacctgcttaccgaagacgaggtacgcgctcagaatcgcgaaaagttgaaggagatgatggacgattactaccgcgacgtcatcgatagcacattgcgcggcgagttgttaattgactggtcttatttattctcctgcatgcgcaatcacctgtcggagaattctaaggaaagcaagcgtgaattggagcgcacccaagattcagttcgctcacagatccacgacaagttcgccgaacgcgcagattttaaagacatgtttggagcctcgattattacgaaacttctgcctacgtatattaagcaaaattcgaagtactcagagcgctatgacgagagcgtaaaaattatgaagctgtacggtaagtttaccacctcgcttacagactactttgaaacccgtaagaacattttttcaaaggaaaaaatctcgtcggccgtgggatatcgtatcgtcgaagagaatgctgagatctttttacaaaaccaaaacgcttacgaccgcatttgtaagattgcgggtttagatctgcacgggttggataacgagattacagcatatgtggatggaaaaacgcttaaagaggtctgtagcgatgagggattcgccaaagtaattactcaaggtggaatcgaccgctacaacgaggcaatcggagccgttaatcagtacatgaatttactgtgtcaaaaaaacaaagcgcttaaaccggggcagttcaaaatgaagcgccttcacaaacagatcttatgcaagggaaccacgtccttcgacatccctaaaaagtttgagaacgacaaacaggtctatgatgctgtcaactcgttcacagagatcgtaacgaagaacaacgacttaaaacgcttgcttaacatcacccaaaacgcaaacgactatgatatgaacaagatctacgtggttgcagacgcctactctatgatcagccagtttatctcaaagaaatggaacttgatcgaggagtgtttgcttgactattactcagacaaccttcctggtaaaggcaatgccaaagaaaataaggtcaagaaagcggttaaagaagaaacataccgcagcgtgagtcaactgaatgaggtaatcgaaaagtactatgtggagaaaacaggtcaaagcgtctggaaagtggaatcatacatttcttctttagctgagatgattaaattggaactttgtcacgaaatcgataatgacgagaaacacaacttaatcgaagacgacgagaaaatcagtgagattaaggaactgctggatatgtacatggatgtttttcatattatcaaagttttccgcgttaacgaggttttaaactttgacgaaacattttatagcgagatggatgaaatttaccaggacatgcaggaaattgtgccgttatacaatcatgtccgcaactatgttactcagaagccctacaaacaggagaaatatcgcttatatttccacaccccaacacttgctaacggctggtcgaaaagcaaggaatatgacaataacgcaatcatccttgttcgtgaagataaatattatctggggatcctgaatgccaaaaaaaaaccgtcaaaagaaattatggctggaaaggaagactgttcagaacacgcctatgcaaagatgaactactacttgctgcccggagccaataagatgctgccaaaggtatttttgagcaagaaggggatccaagactaccaccccagttcctacatcgtcgaaggctacaacgagaagaaacacatcaaagggagtaagaacttcgacattcgtttctgccgcgacctgatcgattacttcaaggagtgtatcaaaaaacacccagactggaacaaatttaatttcgagttctccgctacggaaacttatgaagatatttcggtcttttaccgcgaagtggagaagcaagggtaccgtgtggagtggacgtatatcaacagtgaggatattcagaagctggaagaagacgggcaactgttcctgtttcagatctataacaaagatttcgccgtggggtcgactgggaagcctaatttacatactctttatttaaaaaatctgttctcggaggagaacttgcgtgatattgttttgaagcttaatggcgaggctgagatctttttccgcaagagttccgttcaaaaacctgtgattcataaatgtggtagcatcttggtaaaccgcacttacgaaatcaccgaaagtggaaccacgcgcgtacagtcaatccctgaatctgagtacatggagctgtatcgctatttcaacagcgagaaacagattgaactgtctgacgaagctaagaaatacttagacaaggttcagtgcaataaggcaaagacagatatcgtaaaagactatcgttataccatggataaatttttcattcatttgcccattactatcaattttaaagtcgacaaaggcaacaatgtcaacgccattgctcaacagtatatcgctgaacaagaggatctgcatgtcatcggcattgatcgtggcgaacgtaatttaatttacgtgagcgttatcgacatgtacgggcgtatcttagaacagaaatcatttaaccttgtagaacaggtgtcaagccagggtacaaaacgctattatgattacaaggagaagcttcaaaaccgcgaagaggagcgcgacaaggctcgtaagtcttggaagactatcggaaaaatcaaagagctgaaggaggggtatctgagctcggtcatccacgagatcgcccagatggtcgttaaatataatgcaattattgcgatggaagaccttaattatggctttaagcgcggacgtttcaaagtggagcgtcaggtgtatcagaagtttgaaaccatgcttatttcgaagttaaattatttggcagacaagtcgcaagcggttgatgagccggggggcatccttcgcggataccagatgacctacgtaccggataatatcaagaatgtggggcgtcaatgtgggatcattttttatgttccggctgcgtacacgtcaaagattgaccctactaccgggtttattaatgctttcaaacgcgatgttgtctccacaaacgacgcaaaggaaaattttttgatgaaatttgactccatccaatacgatatcgaaaaagggcttttcaaatttagcttcgactataaaaattttgcgacccacaaattaacgcttgcaaaaactaagtgggatgtatacacaaacggtactcgtattcaaaatatgaaagtggagggccattggttatctatggaggtcgagcttactactaaaatgaaggaattacttgatgattcgcatatcccatacgaggaaggccaaaacatcctggatgaccttcgtgagatgaaagacattacgacaattgtcaatggtatcttggaaatcttttggcttacggtacagttgcgtaattcacgtatcgacaacccagattacgaccgcattatttctccagtgcttaacaatgatggggaatttttcgattcagatgagtacaacagctatattgacgcccagaaggcaccgcttccgatcgacgcggatgccaacggagccttctgtattgctttgaagggtatgtatactgccaaccaaatcaaagagaactgggtcgaaggtgagaaattaccagctgattgtctgaaaatcgaacatgcctcttggttggccttcatgcaaggggaacgtggatag

SEQ ID NO: 825 - DNA, 3864 bp, synthetic construct
  misc_feature 1..3864: note = Description of Artificial Sequence: Synthetic polynucleotide
  source 1..3864: mol_type = other DNA
atgagctacaaccgcgagaagatggaagaaaaggaattaggaaagaatcagaatttccaggaatttattggagttagcccattgcagaaaactttgcgtaacgaactgattcccactgaaactactaagaagaacatcgcccaattagatctgcttaccgaagacgaggtccgcgcacagaatcgcgaaaagttaaaagaaatgatggatgactattatcgcgatgttattgactcaacattgcgtggtgagttacttattgactggtcatacttattttcgtgcatgcgcaatcacctttcggaaaattccaaggagagtaagcgtgaattggaacgtactcaagattctgtccgtagtcagatccacgacaagtttgctgaacgtgctgattttaaggacatgtttggggcatccattattacgaaattacttccaacttacatcaaacaaaattcgaagtactctgagcgctatgatgaaagtgtgaagattatgaaactttacggtaaatttacaacctcacttacggattactttgagacacgtaagaatatctttagcaaagagaagatctcatcagcggtcggttatcgcatcgtcgaggagaacgcggagatctttttacaaaaccaaaacgcttacgatcgcatttgtaaaattgcggggctggacctgcacggacttgacaatgagatcacagcatacgtggatggaaaaacccttaaggaagtttgcagtgacgagggcttcgcgaaggtaatcactcaggggggaatcgaccgctataatgaagcaatcggtgccgtgaaccaatacatgaacctgttgtgccaaaagaataaagctcttaaaccaggtcaatttaaaatgaaacgtcttcataagcaaatcttatgtaaaggcacgacgagcttcgacatccctaagaagttcgaaaatgataagcaggtttatgacgccgtaaactcgtttactgaaatcgttacgaaaaataatgacttaaagcgtttgcttaacatcacgcaaaacgcgaacgattacgacatgaataaaatctacgtcgtcgcagatgcgtattctatgatctcccagtttatctctaagaaatggaatttgatcgaggagtgcctgctggattactattctgacaatcttccgggcaaaggaaacgctaaagaaaataaggtcaagaaggcagtgaaagaggagacatatcgtagtgttagtcagttgaacgaggtcattgaaaagtattacgttgagaagaccggtcagtcggtgtggaaggtggagtcgtatatttcgtcactggctgaaatgattaagttagaattatgtcatgagattgacaatgatgaaaaacataatcttattgaggatgacgaaaagatttctgaaatcaaggaactgctggacatgtacatggatgtgttccacattatcaaggtatttcgcgttaatgaagtcttgaacttcgatgaaacgttctatagcgagatggatgagatttatcaggatatgcaagaaattgtccctttatataaccatgtccgtaactatgttactcagaagccatataagcaagaaaaataccgcctttactttcacacgccaactttagcgaacgggtggagcaaatcaaaggagtatgataataacgccatcatcttggttcgtgaagacaaatattatttaggaattcttaacgccaagaagaaaccatcaaaagagatcatggcagggaaggaagactgttcagagcacgcttacgccaaaatgaactactaccttcttccgggtgcaaataagatgttgccaaaagttttcttgtccaaaaaagggattcaagattaccatcccagttcttacattgtggagggatacaatgagaaaaagcacattaagggctctaagaactttgacatccgtttttgtcgcgacttaattgactattttaaagaatgtattaagaaacatcccgattggaacaaatttaatttcgaattcagcgcgacggaaacctatgaagacattagtgtattttatcgcgaagtggaaaaacaaggttaccgcgttgagtggacctacattaacagcgaggacattcagaaattggaggaggatgggcaactgttcttgtttcaaatctacaacaaagatttcgctgtcgggtccactgggaaaccgaacctgcatacgctttatttgaagaacttattttcggaagagaatcttcgtgacattgttctgaaacttaacggggaagcagagattttttttcgcaagtcgtccgtccaaaaacccgtaattcataaatgtgggagcattttagtaaaccgcacatatgagatcactgaaagcggaactactcgtgttcagtcgattcctgagtctgagtatatggagttgtaccgctatttcaattctgagaaacaaattgagctgtccgacgaggcgaagaagtacttagataaggtacagtgtaataaggcaaagacagacatcgtgaaggactaccgttatacgatggacaaattcttcattcatctgccaattactattaatttcaaggttgataaaggcaacaatgtgaacgcaatcgcacagcagtatattgctgagcaggaagacttgcacgtcatcgggatcgaccgtggagaacgtaaccttatctatgttagtgtcattgacatgtacggacgcattctggagcagaagtcattcaacttggtagaacaggtatcgagccaaggcacgaagcgttattacgattacaaggagaaactgcagaaccgcgaggaagaacgtgacaaggcccgcaaaagctggaaaacaattggcaaaattaaagaattaaaagaagggtaccttagttcagtcatccatgagattgcccagatggtggtcaagtataacgcaatcattgcaatggaagatctgaattatggcttcaagcgtggtcgctttaaggtcgaacgccaagtctatcagaaattcgagaccatgcttatcagcaaacttaactacttagcagacaaatcgcaggcagtagacgaacctggcgggatccttcgcggctaccaaatgacgtatgtacctgacaatatcaaaaacgtcggtcgccaatgtgggattattttttacgtaccggcggcctacacgtcaaaaattgatcctacaacggggtttatcaacgcatttaaacgcgatgtggtttcgacaaacgatgcgaaggagaactttctgatgaaatttgactcgatccagtacgatattgaaaagggcctgttcaaattctcgttcgactacaaaaatttcgcgactcataaactgacgctggccaagacgaagtgggatgtctacacgaatgggacacgtattcagaatatgaaggtggaaggacattggttgtcaatggaggtcgagcttacgacgaaaatgaaggagcttctggatgacagccacattccctacgaggagggccaaaatatcttagatgatttgcgcgagatgaaagacatcacaaccattgttaatggaatccttgagattttctggctgaccgtacaattacgtaattcacgcatcgacaacccggattatgatcgcattatttctccagtgctgaataacgatggcgagttctttgattctgacgaatacaattcttatattgacgcacagaaagcgcctttacctatcgacgcagatgccaatggcgcattttgcattgcactgaagggcatgtatacagctaaccaaattaaagagaactgggttgaaggtgagaaattaccagctgattgcttaaagatcgagcacgcatcttggttggcatttatgcagggggaacgcggatag

SEQ ID NO: 826 - DNA, 3888 bp, Limihaloglobus sulfuriphilus
  source 1..3888: mol_type = genomic DNA
atgagtgcagtatttaaaatcaaggagagtaccatgaaggactttacacatcagtattcactgagcaagacattgaggtttgagctcaaacccgtcggagaaacggcagagaggatcgaggatttcaaaaatcaggggctcaaaagtattgttgaagaagaccgccaacgagcagaagattataaaaagatgaaaaggattctcgacgattatcacaaagaatttatcgaagaggtgctcaatgacgacatcttcaccgcaaacgaaatggaatctgctttcgaagtgtaccgcaaatatatggcgagtaaaaatgatgataagctgaaaaaagaaatcaccgaaatttttacagatttaagaaagaaaatcgcaaaggcttttgagaataagagcaaagaatattgtctttacaaaggcgacttcagcaaactgataaacgaaaagaagaccggaaaagacaaagggccgggaaaactctggtactggcttaaagctaaggcagatgcaggagttaacgaattcggagacggccaaacttttgaacaagccgaagaagccttagccaaattcaataatttcagcacctatttcaccggattcaaccagaatcgtgacaatatctacacggatgctgaacagcaaaccgctatcagctacagagtaataaacgaaaatatgaccagatattttgacaactgcattcgatactccagtattgaaaacaaatatccggaactcgtaaaacagcttgagccgcttagcggcaaattcgcccccggaaactataaagattatctaagccagactgccatcgatatttacaacgaagctgtcggccataagtctgatgacataaacgcaaagggtatcaaccagttcatcaatgaataccgacagagaaacagcataaagggccgcgagctgccgattatgtccgtactctacaaacagatattaagcgatattaataaagatctcattatcgacaagttcgagaacgccggcgagcttttggatgctgtaaaaacactccacagagaattaactgataaaaagattttgctcaagattaaacaaactcttaacgaatttctcacagaagacaattcggaggatatttacatcaaaagcggcaccgatcttacagcagtttcaaacgctatatggggcgagtggtctgttattcctaaagcactcgaaatgtacgccgaaaacataactgacatgaatgctaaagccagagaaaaatggctgaaacgagaagcctaccatttgaaaaccgtacaggaagcgatagaagcgtacctgaaagataacgaagaatttgaaacccggaatatatcagaatatttcacaaattttaaatccggcgaaaacgaccttattcaagttgtccaaagtgcttacgcgaaaatggaatcgattttcggtatagaggattttcacaaagacaggcgtcccgtcacagaaagcggcgagcccggagaaggtttcagacaggtagaacttgttcgggagtatcttgacagcctgataaacgtagaacactttataaaaccgctgcacatgttcagaagcggtaagccgattgagctggaagactgcaacagcaacttctacgatcctttgaatgaggcatataaggaactcgatgttgtattcggcatatacaacaaagtaagaaattacgttacccaaaaaccctattcaaaggataaatttaaaatcaattttcaaaacagcacccttctcgacggctgggatgtaaacaaagaatcagccaacagctctgttttgctgttaaaaaatggcaaatattaccttggtgtaatgaagcagggcgcaagcaatatcctcaattaccgcccagagccgagcgatagcaaaaacaaaataaacgccaaaaaacagctttcagaaatagcacttgcaggggcaacggatgattattacgagaaaatgatatataaactgttgcctgaccctgctaaaatgctgccaaaagtgtttttcagcgccaaaaacattgaattttacaacccttcccaggaaataatatatatcagggaaaatgggcttttcaagaaagacgccggcgataaagagtcccttaaaaagtggatcggtttcatgaaaacatcgcttttaaaacaccctgaatggggtagttactttaactttgaatttgagcccgctgaagattatcaggatatcagtattttttacaaacaagttgcagagcagggctactctgttacttttgacaaaataaaaacaagttacatagaagaaaaggttgccagtggagagctgtatctctttgaaatatataataaggatttttctccacacagcaagggacggcccaatctgcatacaatgtactggaaaagtctttttgaaaaagagaatctccaaaatctcgtaactaaactcaacggcgaggcggaggtcttcttccggcagcattccataaagagaaacgagaaggtggttcacagagccaaccggccgatacaaaacaaaaaccccctcaccgaaaagaaacaaagcatctttgaatacgacctcgtgaaagaccgccggtttacaaaggataaattttttctgcattgccctattacgctgaacttcaaagaggccggacccggcaggttcaacgacaaagtcaacaaatatatcgccggcaatccggacatcaggataataggcattgacagaggagagaggcacctgctctattacagcctcatagaccagagcggcagaatcgtggagcagggcacacttaaccagataaccagtaccctcaacagcggcggcagggaaatacccaaaaccaccgattaccgcggcctgcttgatacaaaagaaaaagaacgggacaaggcgagaaaatcatggtcaatgattgaaaacattaaagagctcaaaagcggctatctctcgcatattgtccataaactcgctaaactgatggttaagaataatgcagttgtggtgcttgaggatcttaatttcgggttcaaacgcggccgattcaaggttgaaaaacaggtttaccagaaatttgaaaaggccctcatagaaaagctgaactatcttgttttcaaagacgcccggcccgcagagccggggcattatctcaacgcataccagcttaccgcacctcttgaaagttttaaaaagctcggcaaacagagcggatttatatactatgtgccggcgtggaacacctcaaagattgaccctgttaccggttttgtaaatcagttttacatcgaaaagaactcaatgcagtaccttaaaaacttttttggtaaattcgattcgataaggtttaacccggataaaaattacttcgagtttggatttgactacaaaaactttcataacaaggccgccaaaagcaaatggactatctgcacccatggagacaaacgctcatggtacaaccgtaaacagagaaaactggagattcacaatgtaacagaaaatctggcaagcctgctcagcggcaaaggcataaatttcgctgacggcggcagtatcaaagacaaaatactatccgtagatgatgcgtctttctttaaaagccttgcatttaattttaaactcaccgcccagcttaggcacacattcgaggataacggcgaggagatcgactgcattatctcacctgtcgcggcggctgacggtacattcttctgttctgaaacggcaaaaaaacttaacatggaattaccccatgacgccgacgcaaacggtgcttataatattgcccgtaagggtcttatggttctaaggcagatacgcgaaagcggcaagcccaagccaatctcaaacgccgattggttagacttcgcccagcagaatgaagattga

SEQ ID NO: 827 - DNA, 3888 bp, synthetic construct
  misc_feature 1..3888: note = Description of Artificial Sequence: Synthetic polynucleotide
  source 1..3888: mol_type = other DNA
atgtctgctgtattcaaaatcaaggagtctacaatgaaggattttactcaccaatacagtctgagcaagacacttcgcttcgagctgaaaccagttggggaaaccgcagagcgcattgaggacttcaaaaaccaaggattaaagtccattgtagaagaagaccgccagcgtgctgaagattataaaaagatgaaacgtattctggatgactatcacaaagagttcattgaggaggtgttaaacgatgacatctttacggccaacgaaatggagtccgcgtttgaggtatatcgtaaatatatggcgtcaaaaaacgatgataaacttaagaaagaaatcactgagatttttacagaccttcgcaaaaaaattgcgaaagccttcgaaaataaatcgaaggagtattgcctttacaagggggatttctcgaaattgattaacgaaaaaaaaactggtaaggataaaggccccgggaaactgtggtattggcttaaagcgaaggcagacgctggtgtcaacgagttcggtgacgggcaaactttcgagcaggcagaagaagccttagctaagtttaataattttagcacctactttacaggtttcaatcaaaatcgcgacaatatttacactgatgcggaacagcagaccgctatctcatatcgtgttatcaatgagaacatgacacgttacttcgataattgcatccgctattcttcaatcgaaaacaagtatcctgaacttgtgaaacaactggagccccttagtggtaagttcgctccaggaaactataaagactatctgtctcaaacagcgattgatatctataatgaggctgtcggacacaaaagtgacgatattaacgcgaagggtatcaaccaattcattaacgagtatcgccagcgtaactcaattaaggggcgcgaattgccgattatgtcagtgctgtacaaacaaatccttagtgatatcaacaaggacttaatcatcgacaagttcgagaacgctggagagctgcttgacgcagttaaaactctgcatcgtgagttgacggacaaaaaaattttgcttaaaattaagcagacgttgaacgagttcttgacagaagataatagcgaagacatttatattaagtcaggcacagatttaaccgcggtgtcgaacgccatctggggtgaatggtccgtgattcccaaggcgttagaaatgtacgcggaaaacatcacggatatgaacgctaaagcacgtgaaaaatggttgaaacgtgaagcatatcatcttaagacagtacaagaagcgattgaggcatatttgaaagacaatgaggagtttgaaacacgtaacatctccgaatacttcacaaatttcaagagcggagagaatgaccttattcaggtagtacagtcggcttatgccaaaatggagtctatctttggtattgaggacttccacaaggatcgtcgcccagtgaccgaatcgggtgaaccgggagagggttttcgccaggtagagttagtccgcgagtatcttgatagtcttattaacgtagaacactttatcaaaccacttcatatgtttcgcagcggtaagccgattgagctggaagattgtaatagtaacttctacgatccacttaacgaagcttataaagagttggatgttgtgtttggcatctacaacaaagttcgcaactacgtgacacaaaaaccctattcgaaagataaatttaagattaacttccaaaactccacgcttttagacggttgggacgttaacaaggaatctgccaactcttccgtattgttgttgaaaaatgggaaatactatctgggggtgatgaaacaaggcgccagcaatattttaaactaccgtccagaacctagcgattccaagaataaaattaatgctaagaagcaacttagcgagattgctttggcgggtgccactgacgactattatgagaaaatgatctataagttgttgccggacccggccaaaatgctgccaaaggttttctttagtgcgaaaaatatcgagttttacaatcctagtcaggaaatcatctacattcgcgagaatgggttattcaaaaaagacgcaggtgataaggaatcactgaagaagtggattggtttcatgaaaacaagtttgctgaaacacccagaatggggcagttacttcaattttgaatttgagcctgccgaggactatcaggatatctcaatcttttacaaacaggtcgcagaacaaggctattccgtcacctttgacaagatcaagacgtcgtacattgaggagaaggtagcaagcggagaactttatttattcgaaatttataataaagatttttcgccgcattccaagggtcgtcccaatcttcatactatgtattggaaatcattattcgagaaggaaaatctgcaaaacttagtgacgaaactgaatggcgaggccgaggtattctttcgccaacatagcatcaagcgtaacgaaaaggttgtacatcgcgccaatcgtcctatccagaacaagaatccactgacagagaaaaaacagtcaattttcgaatatgatttggttaaagaccgccgttttacgaaggacaagtttttcttacattgccccatcactttgaacttcaaggaggctggccccgggcgctttaacgacaaagtgaataagtatattgcaggtaacccggacattcgtatcatcgggatcgaccgcggggagcgtcaccttttatattactcgcttattgaccaaagtggccgtatcgttgagcagggaacactgaaccagatcacgtctaccttaaatagcggagggcgcgaaatccctaagacgacagattaccgcggcttactggacacaaaggagaaggaacgtgacaaggcccgcaagtcctggtctatgatcgaaaacattaaggaacttaaatcgggatatttatcgcatatcgtgcacaagttggctaaattaatggtcaagaacaacgcagttgtagtattggaagacttgaacttcgggtttaagcgcggacgtttcaaagtcgaaaagcaagtgtaccagaaattcgaaaaagcattgatcgagaaactgaattatttggtttttaaagacgcccgccccgcagagccagggcactacttaaacgcttaccaactgacggctcctctggagtcattcaaaaaacttggtaagcaatcaggcttcatttattacgttcccgcatggaacacgtcgaagattgatccagtcactggcttcgtgaatcagttttacattgaaaaaaatagtatgcaatatttaaaaaatttcttcgggaaatttgactcgatccgttttaatcccgacaagaactacttcgagtttggtttcgactataaaaacttccacaataaggcagcgaaatctaagtggaccatctgtactcatggagataagcgcagttggtacaaccgcaagcaacgcaaacttgagatccataacgttactgagaacctggcgtcgcttctgtccggcaaaggcattaacttcgctgatggtgggtccatcaaagacaaaattcttagtgtagacgacgcaagtttttttaagtctttagcttttaacttcaaattgaccgcccaacttcgccatacctttgaagataatggagaggagatcgattgcatcatctcgcccgttgcagctgcagatgggacttttttctgttcggaaacggctaaaaaacttaatatggagttaccgcatgacgcagatgctaacggggcgtataatattgcacgtaagggactgatggtcttgcgtcaaatccgcgaatcgggcaagccaaaaccgatctcaaacgcggattggcttgatttcgcgcaacaaaatgaggattga

SEQ ID NO: 828 - DNA, 3888 bp, synthetic construct
  misc_feature 1..3888: note = Description of Artificial Sequence: Synthetic polynucleotide
  source 1..3888: mol_type = other DNA
atgagcgctgtttttaagatcaaggagtcgacaatgaaagatttcacccatcagtacagtttatcgaaaacgctgcgtttcgaattgaaacctgtaggggagacagctgagcgcatcgaagattttaagaaccaaggcttaaaatcgattgttgaagaggatcgccagcgtgcagaagattacaaaaaaatgaagcgcatcttggatgactatcacaaagagtttattgaagaggttcttaatgacgatattttcaccgccaatgaaatggaatcggctttcgaggtgtatcgtaagtacatggcttccaaaaatgatgacaaactgaaaaaggaaattactgagatcttcactgatttgcgtaaaaaaatcgctaaggcgttcgagaataaatctaaagaatactgtctttacaaaggtgatttttcaaaattgatcaacgaaaaaaagacgggtaaagacaaagggccagggaagctttggtattggctgaaggcgaaggcagacgcaggcgttaacgagtttggtgacgggcagacattcgagcaagccgaggaggcattagccaagtttaataacttcagcacgtattttacgggttttaaccaaaaccgtgacaacatttacactgacgcagagcaacagactgcaatctcataccgcgttattaatgaaaacatgactcgttactttgacaattgtatccgctatagcagtatcgagaataagtacccggagctggttaaacagttggaacccttaagcgggaagttcgctccagggaactataaggattatctgtcccagactgcaatcgatatctataatgaggctgtagggcataagtcagacgatatcaatgcgaaggggatcaatcagtttatcaacgaataccgccaacgtaactcgatcaagggccgcgaattaccgattatgtctgtgttatacaaacaaattttatcagacattaacaaagacttaattatcgacaagttcgagaacgccggagagcttcttgatgctgtaaagactcttcaccgtgaattgaccgataagaagatcttattgaaaattaaacaaacacttaacgagttcttaaccgaggacaattcggaagacatttacatcaaaagtggtactgatctgactgctgtttctaacgcgatctggggagagtggtccgttatcccaaaagctttagaaatgtatgctgagaacattacggatatgaatgcaaaggctcgtgagaaatggttaaagcgcgaagcgtatcatttgaagactgtacaagaggcgatcgaagcgtatcttaaggataacgaggagtttgagacccgtaacatctcggagtactttactaattttaaatccggcgagaacgatttaattcaggtggttcaatcagcatacgcaaaaatggaatcgatttttggaattgaagactttcataaggatcgtcgccccgtgacagaatctggcgaaccgggtgaagggttccgtcaggtcgagttggtgcgcgaatacttggactcattaattaatgttgagcactttattaaaccgcttcatatgtttcgttcaggcaaacccattgaacttgaggactgtaattctaatttttatgacccgttaaacgaggcatacaaggaattagacgtagtgttcggtatttacaacaaagtacgcaactacgtcacccagaagccatactcgaaagacaaatttaaaatcaattttcagaactctactttgttagatggttgggacgtcaataaggaatcagccaactcatcagtactgttacttaaaaacggcaaatattacctgggtgtcatgaaacaaggggcgagtaatatcttgaattaccgtcccgagccttctgattctaagaataaaattaacgctaaaaagcagttgagcgagatcgccttagctggcgccacggacgattactacgagaaaatgatctataaactgttgcctgatccggcaaagatgctgccgaaagttttttttagcgccaagaacattgaattttacaaccctagtcaagagatcatctacatccgcgaaaatggtcttttcaagaaagacgcaggagataaagaatcgcttaagaagtggattggctttatgaaaacgagtcttttgaagcacccggagtggggttcttatttcaattttgagtttgagcctgcagaggactaccaggatatctccattttttataagcaagtggcagaacagggatattccgtgacgttcgacaagatcaagacaagctatatcgaagaaaaggttgccagtggagagctgtaccttttcgagatctataataaagatttctctcctcactccaaaggccgtccgaacttgcatacaatgtactggaaaagtctgttcgaaaaagagaatctgcagaacttggtgacaaaattgaatggagaagcagaagtttttttccgccaacacagtattaagcgtaacgaaaaagtcgtacaccgcgcgaaccgtccaatccaaaataagaatccgttgacagagaaaaaacagtcaatctttgaatacgatcttgtgaaggatcgccgctttacaaaagacaagttttttttacactgtcctatcacattaaattttaaagaagctggacccggccgtttcaacgataaggtcaacaagtacatcgccgggaaccccgatatccgtattatcggcattgaccgtggagagcgccacttactgtattattctttaattgatcagagcggacgtatcgtagagcaagggacgcttaaccaaattacctcaactcttaattctgggggtcgtgagatcccgaagactactgattaccgcggattgttggacacgaaggaaaaagaacgtgacaaagcacgtaagagctggtccatgatcgagaatattaaagaacttaaaagtgggtatctgtctcacatcgtccataagttggcgaagcttatggttaaaaataacgcggtcgtcgtattggaggatttgaattttggtttcaaacgcggacgttttaaggtagagaagcaggtgtatcagaaattcgaaaaagctttaattgaaaagcttaactatctggtatttaaggacgcacgtccggctgaaccaggccattatttaaacgcataccaattaacggccccgcttgagagttttaagaaattaggtaagcagtcaggctttatttattacgttccagcgtggaacaccagcaagattgaccccgtaaccgggttcgtaaatcaattctacattgagaagaactctatgcagtacttgaaaaacttctttggcaagttcgattccatccgtttcaatccagacaaaaactatttcgagttcggattcgactacaaaaatttccacaataaagctgcaaaatcgaagtggacgatttgcacacacggagacaagcgtagttggtataaccgcaagcagcgtaaattggagattcacaatgtcaccgaaaacttagcttcgttgttatccggcaaggggattaattttgctgacggcgggtctatcaaagacaagatcttatctgtggatgacgcatcctttttcaagtcattagcgttcaatttcaagttaacagcgcaactgcgccatacattcgaagacaacggagaggaaatcgactgcatcatctcccccgttgcggcagcagacggaactttcttttgctctgaaacagcgaaaaaattaaatatggagctgccacacgatgctgatgccaatggagcatataacatcgcccgcaaaggcttaatggttttacgccaaatccgcgaatctggcaaaccaaaacccatctcgaatgctgattggttggactttgctcagcaaaacgaagactga

SEQ ID NO: 829 - DNA, 3888 bp, synthetic construct
  misc_feature 1..3888: note = Description of Artificial Sequence: Synthetic polynucleotide
  source 1..3888: mol_type = other DNA
atgagtgctgtctttaaaattaaggagtccacgatgaaggactttactcatcagtattcactttccaaaactcttcgcttcgagttaaaacccgtcggagaaacagcagaacgtatcgaagatttcaaaaatcaaggccttaagtcgattgtggaagaggaccgtcagcgcgccgaggactataaaaaaatgaaacgtattttggacgattatcacaaggaattcattgaggaggtattgaatgatgatatctttacagctaacgaaatggaatctgctttcgaggtgtatcgtaagtacatggcctccaagaatgatgataaattgaaaaaggaaatcaccgaaattttcacggatctgcgcaaaaaaattgcgaaggcatttgagaataaaagcaaagagtactgcttatacaaaggagacttttcaaaattgatcaacgagaaaaaaacggggaaggataagggtccgggaaagctgtggtactggcttaaagcaaaagcagatgctggggtgaacgagtttggagacggccaaacctttgagcaagcggaggaagcccttgctaaatttaataatttttccacttatttcacaggcttcaatcaaaaccgtgataatatttacaccgatgctgagcaacaaacagcgatctcgtaccgcgttatcaatgagaatatgacccgttactttgataactgtattcgttattcatcaattgagaacaagtaccccgaactggtgaaacagttggagcctctgtccggcaagttcgctccagggaattataaagactatctttcgcagactgcaatcgatatctataatgaggctgtgggccacaaatctgacgatatcaacgcgaagggcattaatcaattcatcaacgagtaccgtcaacgtaattccatcaaggggcgcgagttgccgattatgagtgtactttacaagcaaatcctgagcgacatcaacaaggacctgatcattgataagtttgagaacgccggcgaactgctggatgcagtcaaaactttgcatcgcgagcttaccgataagaagatcttgcttaaaatcaaacaaactctgaacgaatttttaaccgaagataattcagaggacatctatatcaaatccggtactgacttaacagcggtgagcaacgcgatctggggcgagtggtcagtcatcccgaaagcattagaaatgtatgccgagaatatcaccgacatgaatgccaaagcccgtgaaaaatggctgaaacgtgaggcataccatcttaagactgtacaagaagcgattgaagcatacctgaaggataatgaagaattcgaaactcgtaacatctcagagtatttcacaaattttaaaagcggagagaatgacttaattcaagtagtccaaagcgcttatgcgaagatggagagcatttttggtattgaggactttcataaagaccgtcgccccgtaacggagagtggggaaccaggagaagggttccgtcaagttgagttagttcgtgagtatttagactctttgattaacgttgagcatttcattaaaccactgcatatgtttcgctccggaaagcctattgagttggaagactgcaactccaatttttatgaccctcttaatgaagcctacaaagaattagacgtagtctttggaatttataacaaggtccgcaactatgtcacgcaaaaaccttattcaaaagacaaatttaagatcaacttccagaactcgacgcttcttgacggatgggacgtgaacaaagagagcgccaattcatcggttttactgctgaaaaacggaaaatactacttgggagtaatgaaacaaggagccagtaacattctgaattaccgccctgagccttcagactctaaaaacaagatcaacgctaaaaaacagctgagtgagatcgcattagccggtgcaacagatgactattacgaaaaaatgatttacaagttattacccgatccggccaaaatgcttccgaaagtctttttttcggccaaaaatattgagttttataatccttcacaagagattatctacatccgtgaaaatggccttttcaagaaggatgcgggcgataaggagtctttgaaaaagtggattggctttatgaagacaagtttattgaaacacccagagtggggtagttatttcaactttgagtttgagcccgcagaggattatcaagacatttctatcttctataaacaggtggctgaacagggttattctgtcacgttcgacaaaattaaaacctcctatatcgaggagaaagttgcatccggcgagctttatcttttcgagatctacaacaaagactttagccctcattctaaaggccgcccgaacttacataccatgtattggaagtctcttttcgaaaaagaaaatctgcaaaatttggtgaccaaactgaatggtgaggccgaagttttctttcgccagcacagcatcaaacgcaacgaaaaagtggtgcatcgcgccaatcgtcccattcagaataagaacccccttacggagaagaagcagtctatttttgagtacgatttagtgaaagaccgtcgttttactaaggataagttttttctgcattgtccgatcactttaaatttcaaagaagctggtcctggccgtttcaacgacaaggtgaacaagtacatcgccggcaatccagatatccgtattattgggatcgatcgcggtgagcgccatttactttactactcgctgatcgaccaaagcgggcgtattgtcgagcaaggaaccttgaatcagatcacgagtacactgaactcaggagggcgtgagattcccaaaacaaccgactatcgtggattgttagacacaaaagaaaaagaacgtgataaagcccgcaagtcttggagcatgattgagaacattaaagaacttaaatcgggatacttatcccacatcgttcacaaacttgcaaaattgatggtgaagaacaatgcagtagtagttttggaggacctgaactttggttttaaacgtgggcgcttcaaggtggaaaaacaggtgtatcagaagtttgagaaggcattaattgagaagttaaattatctggtgtttaaagacgctcgccctgccgagcccggtcactatttgaatgcttatcagttgacggcgcccttggaaagttttaagaagttaggtaaacagtctggattcatctattacgtcccggcgtggaacactagcaaaattgacccagtcactggtttcgtaaatcagttctacattgaaaaaaactctatgcagtatttgaagaattttttcggaaaattcgattcgatccgttttaatccggataaaaattactttgagttcggatttgactacaaaaacttccacaacaaggcggcgaaaagtaagtggaccatctgcacccacggggataagcgcagttggtataaccgcaagcagcgtaagctggagatccacaacgtgacagagaacctggcttcgttattgtcgggcaagggaattaactttgctgacgggggctctatcaaggacaaaatccttagtgttgatgatgcaagcttcttcaaatccttggcgtttaactttaagcttaccgcccaactgcgccataccttcgaggacaatggtgaagaaattgattgtatcatcagcccggttgcagcggcggacggtacgttcttctgttcagagacagccaagaagttgaacatggaattgccccatgacgcagatgctaatggggcctacaacatcgcacgtaaggggctgatggtgcttcgtcagatccgcgaaagcggaaaacctaaacctatctctaatgccgattggttggatttcgcacaacagaacgaagattga

SEQ ID NO: 830 - DNA, 3738 bp, Ruminococcus bromii
  source 1..3738: mol_type = genomic DNA
atgcaagagcgtaaaaaaatatcgcatcttacacacagaaattcagttcaaaaaacaattaggatgcaactgaatcctgtaggtaaaacaatggattattttcaagcaaagcaaattcttgaaaatgatgaaaagcttaaagagaactatcagaaaatcaaggaaatagcagacaggttttacagaaatttaaatgaggatgtactttcaaaaaccgggttagataaattaaaagattatgctgaaatttactatcactgtaatacggatgcagaacgaaaaagacttgacgaatgtgcatcggaattaaggaaagaaatcgtcaaaaattttaagaatcgagatgagtataacaaactattcaataaaaagatgattgagatagttcttccccagcatcttaaaaatgaggacgaaaaggaagttgtagcctcatttaaaaatttcacaacatactttacaggtttcttcactaacagaaaaaatatgtattcggacggagaagaatccacggcaatcgcatatagatgcattaacgaaaatttgcctaagcatcttgacaatgtcaaggcctttgaaaaagcaatttctaaactatccaaaaacgcaattgatgatttagatgccacttattccggcttatgcggtacaaatttgtatgatgtttttacagttgattattttaactttttgcttccacaatccggaattaccgaatataacaaaatcatcggcggttacacaacaagcgacggtacaaaagttaagggtattaacgaatatataaatttgtacaatcaacaagtatccaaacgggataaaattcctaatcttaaaattttgtataaacaaattttaagtgagagtgaaaaggtatcattcataccgccaaagtttgaagatgacaacgaacttttatcggctgtttcagagttttacgcaaacgacgaaacctttgacgggatgccattaaaaaaagcaattgatgaaacaaagctattattcggcaatttagataattcctctcttaatggaatttacattcaaaatgaccgatccgtgacaaatctgtcaaacagcatgttcggttcttggtcagtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttccaattctgaaaatgatgaaatcagagaaaagtctatcgtaaattactacaagacttctttaatgcaacttaccgacaatttgtcagacaaatacaacgaagcagcacctctgctcaacaaaagttacgctaatgaaaaaggtttgaaaaatgacgataaatctatttcattaattaaaaattttcttgatgccataaaagaaattgaaaaattcatcaagcctttgtccgaaactaatattacaggtgagaaaaatgatttgttttacagtcagttcacaccattacttgataatatcagcagaatagacatattatatgataaggtcagaaactacgttacacaaaaaccgttttcaaccgataaaatcaagcttaactttggcaattcacagctattaaacggctgggatcgaaacaaagaaaaagactgcggtgccgtttggctttgtagggatgaaaagtattatcttgcaatcatagataaaagtaataatagtattttggaaaatattgattttcaagactgcgatgaaaacgattgttacgaaaagataatttacaagcttctccccggtccaaataaaatgcttccaaaagttttcttttcagaaaagtgcaagaaacttttgtcaccgtcagacgaaatacttaaaattcgtaaaaacggcactttcaaaaaaggtgataagttcagccttgatgattgccataagttaattgatttctacaaagaatcattcaaaaagtacccaaattggttaatttataactttaaatttaaaaacacaaacgaatataacgatatccgcgaattttataatgatgttgcttcacagggatataatatttcaaaaatgaaaatcccgacatcatttattgacaaacttgtagatgaaggaaaaatctatcttttccaactctacaacaaagacttttcaccgcatagcaaaggtactcctaatctgcatacactttattttaaaatgttgtttgatgaaagaaatcttgaagatgtggtgtacaagcttaacggtgaggcagaaatgttttatcgtcctgcaagtataaaatatgacaaaccaactcatcccaaaaacacaccgataaaaaataaaaatacactcaatgataaaaaaacaagcacttttccttatgacttaattaaagataaacgctacactaagtggcagttttcacttcacttccctattaccatgaattttaaagctccggatagggcaatgatcaatgatgatgtcagaaatctgctgaaatcctgcaacaacaatttcatcataggaattgacagaggcgaaagaaacttgctttatgtcagcgtaattgacagcaacggtgctataatataccagcactcactcaatattatcggaaacaagtttaaaggaaaaacatacgaaactaactaccgggaaaaacttgcaacaagagaaaaagagcgtacggaacagcgccgtaactggaaagcaattgagagtataaaagaactcaaagagggctatatcagtcaggctgtgcatgttatatgtcagcttgttgtcaagtacgatgcaatcatcgttatggaaaagctgactgacggattcaaacgaggcagaacaaagtttgaaaaacaggtttatcagaaatttgaaaaaatgctgattgacaaactgaattactatgttgacaaaaagcttgatccagacgaaggaggcggtttacttcatgcctaccagcttacgaacaagcttgagagctttgataaacttggcatgcaaagcggttttattttctatgttcgtcctgattttacaagcaaaattgatcccgttaccggctttgtaaatttgttgtatcctcgatatgaaaacattgacaaagccaaagatatgatttcaagatttgacgatataggatacaatgccggcgaggacttttttgaatttgacattgattacgataagtttccaaagactgcgtctgactatcgcaagaggtggacaatctgtactaacggcgaaaggattgaagctttcagaaatcccgcaaagaataacgaatggagttatcgtacaataattcttgcagaaaaattcaaagaattatttgataacaattctataaattatcgtgattctgacgatttgaaagctgaaattctttcacagacaaagggcaaattttttgaggatttcttcaaattattaagacttaccctacagatgcgaaacagtaaccctgaaacaggcgaggaccgtattctttctcccgtcaaggacaaaaacggcaatttttacgacagttcaaaatatgatgaaaagagcaagcttccgtgtgatgccgatgcaaacggtgcgtacaacattgcccgcaaaggtttgtggattgttgaacaattcaaaaaatccgataatgtttcaactgtcggaccggtaatccacaatgacaaatggctgaaatttgttcaggagaatgatatggcgaataattaa

SEQ ID NO: 831 - DNA, 3738 bp, synthetic construct
  misc_feature 1..3738: note = Description of Artificial Sequence: Synthetic polynucleotide
  source 1..3738: mol_type = other DNA
atgcaagaacgtaagaaaattagccatcttacccaccgtaatagtgttcaaaagacaatccgcatgcagttgaaccccgttgggaagacaatggactacttccaggctaagcaaatcttggagaacgatgaaaaattaaaggagaattaccaaaagattaaggagattgccgaccgtttctaccgtaacctgaacgaagacgtcttgtctaagaccggtttagacaaacttaaagattacgccgagatctactatcattgtaacaccgatgccgagcgcaagcgtttagacgagtgcgccagtgagctgcgcaaagaaattgtaaaaaattttaaaaaccgtgacgaatacaataagctgtttaataagaagatgatcgagatcgtcttacctcaacaccttaaaaacgaagacgaaaaggaggtagtagcgtccttcaagaactttacgacttattttacagggttctttactaatcgtaagaatatgtactcagatggagaagagtcaacagctattgcttaccgctgtattaatgaaaacttaccaaaacacttagacaacgtgaaagctttcgaaaaggccatctctaaacttagtaaaaacgcaatcgacgaccttgatgccacgtactccgggttatgcggtacaaacctgtacgacgtctttacggttgactactttaacttcttgcttccacagagcggcatcaccgaatataataaaatcatcggtggctatactactagcgatggaacaaaggtaaagggaattaacgagtacatcaatttgtacaatcagcaagtgtcgaagcgtgacaaaattcctaatcttaagattctttataagcagatcctttccgagagcgaaaaagtttctttcattccgcctaagttcgaagacgataacgaattactgagcgctgtcagtgagttctatgctaacgacgagacttttgacggcatgccactgaagaaagcgattgacgaaaccaagctgttattcggtaatttggataactctagccttaatggcatttatatccagaacgatcgttctgtaacgaatttgtcaaactcgatgtttgggtcgtggagcgtaatcgaagacttatggaataagaactacgacagcgtaaatagcaacagtcgtattaaagatattcagaagcgtgaagataagcgcaagaaagcatataaagccgaaaagaagctttctttatccttcttgcaggtcttgatctcgaattcagaaaacgatgaaatccgtgagaagtcgattgtaaattattacaaaaccagtctgatgcaacttactgataacctgtcagataagtataacgaagcagcccctctgttaaataaatcttatgctaatgagaagggattaaaaaatgacgacaaatctatttcgttgattaagaacttcttagatgctatcaaggagattgaaaagttcatcaaacctttaagtgagacaaatatcacgggagagaagaatgacctgttctatagccaattcactcctttattagacaacatttcccgtattgatatcctgtatgataaggttcgtaattacgttacccaaaaaccattctccaccgacaagatcaaactgaactttgggaacagccaattattgaacggatgggatcgcaacaaggaaaaggattgtggtgctgtgtggttgtgccgtgatgaaaaatattatttagcgattattgacaaatcaaacaattcgattttagaaaatatcgattttcaggactgtgacgaaaatgattgttatgaaaaaattatctataaattgttgcccggccccaacaagatgctgcccaaggtgttcttctcggaaaaatgcaagaaattattatcaccctcagatgaaattttaaaaattcgcaagaatgggacattcaagaaaggggataagttcagtttggacgattgccataagctgatcgacttttataaagaaagcttcaagaaatatccaaactggttaatttataattttaagtttaaaaacacaaacgagtacaacgacatccgtgaattttataacgacgtcgcaagtcaaggttataatatcagtaaaatgaagattccaacgagtttcattgacaagttggttgacgagggtaagatctacttgtttcagctttacaataaggatttttctcctcattcaaaaggtacccccaaccttcatactctgtattttaaaatgctttttgatgagcgcaacttagaggacgttgtttacaagttgaacggggaagcggagatgttttatcgtccagcatcaattaagtatgataaacccacgcatcccaaaaacacgccaatcaagaacaagaatacactgaacgataaaaagacatcgaccttcccctacgatttaattaaggataagcgttacacgaaatggcagttctccttgcactttccgattaccatgaacttcaaggcccccgatcgtgccatgatcaatgacgatgtacgtaaccttttaaagtcttgtaataacaatttcatcattggcattgaccgtggagagcgcaacttgttgtatgtcagtgtgattgacagtaatggggcaattatctaccagcactcattaaatattattggcaataaattcaaaggtaagacttatgagaccaactatcgcgagaagctggcaacacgcgagaaggagcgtacggaacagcgccgcaactggaaagctattgagtctattaaggagcttaaggagggttacatcagtcaggccgtacatgtgatctgtcagttggtggtcaaatacgatgcgattatcgtgatggagaagctgacagacggctttaagcgtggtcgtacgaagtttgagaaacaagtctaccaaaagtttgaaaagatgctgatcgataagcttaactattatgtcgataagaaattagatcccgacgagggggggggattgcttcatgcataccagcttactaacaaattagaaagtttcgacaaattaggtatgcagagtgggtttattttctatgtccgtcccgattttacgagtaagatcgatcctgttactgggtttgtcaacctgttgtaccctcgttatgagaacattgacaaggcgaaggatatgatctctcgctttgacgacattgggtacaatgctggtgaggacttctttgaattcgacattgattatgacaagtttcctaagactgcctccgactaccgtaaacgttggacgatttgtactaatggggaacgtatcgaggctttccgtaatccagcgaaaaacaacgagtggtcttaccgcaccatcattttggcggagaaattcaaagagcttttcgataacaatagtatcaactaccgcgattcggacgacttaaaggctgagatcctttctcaaacgaaaggtaaatttttcgaagatttttttaaactgttgcgtcttaccttgcaaatgcgcaatagtaacccggagactggtgaggatcgtatcttgtcccctgtcaaggacaaaaacggtaatttctacgatagctccaaatacgacgagaaatcaaagttgccatgtgatgccgatgcaaacggggcgtacaacattgcgcgcaaaggcttatggattgtcgaacagttcaagaagtctgataatgtgtcgactgtcggacctgtaatccacaacgacaagtggcttaagtttgtgcaagagaatgatatggcaaataactaa

SEQ ID NO: 832 - DNA, 3738 bp, synthetic construct
  misc_feature 1..3738: note = Description of Artificial Sequence: Synthetic polynucleotide
  source 1..3738: mol_type = other DNA
atgcaagagcgtaagaaaatttcacaccttacacatcgtaatagtgtccagaaaacgatccgtatgcaacttaatccagtcgggaaaactatggattactttcaggcaaagcaaattttagaaaatgacgagaaattaaaagaaaactaccaaaagatcaaagagatcgctgaccgtttttatcgcaacttaaacgaggatgtccttagcaaaacagggctggacaagttaaaggattacgcggagatttattaccactgcaacaccgacgctgagcgtaaacgtcttgacgagtgtgcatcggagttacgcaaggaaatcgtaaagaactttaagaatcgcgacgagtacaataagttattcaataaaaaaatgattgaaatcgtgcttccccaacatttgaaaaacgaagatgagaaggaggtggtcgcgtcgttcaaaaactttaccacctatttcaccgggttttttaccaaccgtaagaacatgtattcggacggtgaggagtctactgcaattgcgtaccgttgcattaatgaaaaccttcctaaacacttagacaacgtcaaagcttttgaaaaggctatctcgaaacttagtaaaaacgccatcgatgatttagacgccacgtatagcggcctttgcgggacaaatttatacgacgtgtttacagtagactactttaacttcttgcttcctcagtccggcattactgagtataacaagatcattggcggatacaccacgtctgacggtaccaaagtcaaagggatcaatgagtacattaatttatacaaccaacaagtatcaaagcgcgataaaatcccgaacctgaagattctttataagcaaattctgtctgaaagtgagaaagtatcctttatcccaccgaaatttgaggacgacaacgaactgttgtcggctgtttctgagttctacgcaaatgatgagacctttgacggtatgcctttaaaaaaggccatcgatgaaacaaaattgctgtttgggaacttggataattcctctcttaatgggatttacattcagaacgaccgcagcgtaacgaatttgtccaattcaatgtttggatcgtggtccgtgatcgaagacctgtggaataagaattacgattcagtcaattccaacagtcgcattaaggacatccaaaagcgcgaagacaagcgcaagaaagcatataaggccgaaaagaaactgtctttatcatttcttcaggttttaattagtaactctgagaacgatgagattcgcgagaagtccatcgtgaactattataagacgagtttaatgcagttaacagataacttatctgacaagtacaatgaagcggctcccttgttgaataagtcttacgccaatgaaaaaggtcttaagaatgatgacaagtctatcagcttaatcaagaattttttggacgcgattaaggaaatcgaaaaattcattaaaccattgtccgagactaacattaccggagagaaaaacgacctgttctactcccaattcacaccgttgctggataacatctcacgtatcgacatcctttatgataaggtgcgtaactacgttactcaaaagcccttttccaccgacaagattaagttgaattttggtaacagtcaattgctgaacggctgggatcgcaacaaggaaaaagactgtggtgctgtctggttatgtcgcgacgaaaaatactatctggctattattgataaatctaataactctatcttagaaaacatcgactttcaggactgcgacgagaacgactgctacgaaaagattatctataagttacttcctggccccaacaagatgttaccgaaggtcttttttagcgaaaagtgcaagaaattgctgagtccatctgatgagattcttaaaattcgcaagaatggcactttcaagaagggggacaagttttcccttgatgactgccacaaacttattgacttctataaagaaagttttaagaaatatcctaactggttaatttacaacttcaaattcaaaaatactaacgaatacaatgatattcgtgagttctataatgacgtcgcctcccagggttataacatcagtaaaatgaagatccctacctcctttatcgataaacttgttgatgaaggaaagatctatttatttcaactgtataataaagatttttcgccccatagcaaaggcacacctaatttacatacgctttacttcaaaatgctttttgatgagcgtaatttagaggatgtggtctacaaacttaatggcgaggctgagatgttttaccgccctgcatctattaagtatgataagccaacacaccccaaaaatacgccaattaaaaacaagaatacgcttaacgataaaaaaacgagtaccttcccgtatgatcttattaaggataagcgttacacgaagtggcagttttctctgcattttccaatcacaatgaacttcaaggccccggaccgtgcgatgatcaacgacgacgtacgtaacttgctgaaatcttgtaacaacaacttcattatcggcattgatcgtggcgaacgcaatctgttatacgtgtccgtcatcgattcaaatggagcgatcatttaccaacatagcctgaacatcattgggaacaagttcaaggggaagacctatgagactaactaccgtgaaaaattggcgacccgcgaaaaagaacgcacagagcagcgtcgcaactggaaagctatcgagagcattaaggagcttaaagaaggttatatctcacaggcggttcatgtcatctgccaattagttgtgaagtatgatgcaattatcgtgatggagaaactgaccgatggattcaaacgcgggcgtaccaaattcgaaaaacaggtttatcagaaatttgaaaaaatgctgatcgacaagctgaattactatgtagacaaaaaactggatccagatgagggagggggtctgcttcatgcataccaacttactaataagttggaatctttcgataagttgggaatgcagtcggggtttatcttttatgtacgccctgatttcacgtcgaagattgatccagtgaccggtttcgtaaaccttctgtaccctcgttatgagaacattgataaggccaaagatatgatttcacgtttcgatgatattggttataatgccggggaagattttttcgaatttgatatcgactacgacaaattcccaaaaacagcttcagactatcgtaaacgttggactatttgtaccaatggagaacgtattgaagctttccgtaatccagctaagaataatgaatggagttatcgtacgattatcttggcggaaaaattcaaagaattattcgacaacaattccattaactatcgtgacagcgatgatttgaaggccgaaatcttgtcacaaaccaaggggaaatttttcgaagacttttttaaactgttacgtctgacgcttcaaatgcgcaattcaaacccggaaacgggggaagatcgtattcttagccctgtaaaagataagaatggaaacttttatgacagttccaagtacgacgagaaatctaaattaccttgtgacgcagatgcaaatggggcttataacatcgcgcgcaagggcctgtggattgtcgaacagtttaagaagtcggacaacgtatcgactgttggaccagtaattcacaatgacaaatggctgaaattcgtccaggagaatgatatggcaaacaattaa

SEQ ID NO: 833 - DNA, 3738 bp, synthetic construct
  misc_feature 1..3738: note = Description of Artificial Sequence: Synthetic polynucleotide
  source 1..3738: mol_type = other DNA
atgcaggaacgcaagaaaattagccaccttacgcatcgtaacagtgttcagaagacaatccgcatgcagctgaatccagttggaaagacgatggattacttccaagccaaacagattttagagaacgatgagaaattaaaagaaaactaccagaaaattaaagaaattgctgatcgcttttaccgtaacctgaacgaagatgtgttatcgaagaccggcttggacaagctgaaggactatgccgagatttattaccactgcaatactgacgcagaacgtaaacgtctggatgaatgcgcctccgaacttcgtaaggaaatcgtcaaaaacttcaagaatcgcgacgagtataataaattgtttaataaaaagatgatcgaaatcgtgttgccacaacacttaaaaaacgaagacgagaaggaggttgtcgcgtctttcaaaaacttcaccacatattttacgggttttttcaccaaccgtaagaacatgtactctgatggcgaagaatcaactgctattgcctaccgttgtattaacgagaatctgccgaagcacttggacaacgtaaaggccttcgaaaaggcaatctctaaactgtctaagaacgcgattgacgacttggacgcaacatactcgggcttatgcgggacaaatttgtatgatgtatttactgtggactactttaattttcttttgccgcagtcaggtattaccgaatacaataagatcattggcggctacaccacatctgacggcacgaaggttaaggggattaacgagtatattaatttatacaatcagcaagtatctaagcgtgacaagattccaaacctgaagatcctgtacaagcagattctttcggaatccgagaaggtctcctttatcccacccaaatttgaagacgacaacgaacttctgtcagcagttagtgagttctacgcgaatgacgagacatttgatggaatgccgctgaaaaaagctattgatgagacaaagcttttattcggtaacttggataactcaagtttgaacggcatctacatccagaatgaccgctcagtgacgaacttgtccaatagtatgtttggtagttggtccgtaatcgaagatttatggaataagaattatgattctgtgaacagtaactcccgtattaaggatatccaaaagcgtgaagacaagcgtaaaaaagcgtacaaagcggaaaaaaaactgtccttatcatttttacaagtacttatcagcaactcggagaacgacgagatccgtgaaaagagcattgtaaactattacaagacgagcctgatgcaacttacggataaccttagtgataagtataacgaggcagcaccgttacttaataaatcgtatgctaacgaaaagggactgaagaatgacgataagtctatctcgttaattaaaaacttcttagatgccatcaaggaaattgagaaatttattaagccacttagcgagacgaacatcacaggggagaagaacgacttgttttattcacaatttacgcctcttcttgataacatcagtcgcattgacattttatacgacaaagtacgtaactacgtgacacagaagccattctcaaccgacaaaattaaacttaacttcggtaattcccaattgcttaatggttgggatcgcaacaaagagaaagattgtggcgctgtgtggctttgtcgcgacgagaagtactatcttgccatcattgacaagagtaataatagtattttagaaaatatcgattttcaggactgtgacgagaatgattgctatgagaagatcatttacaaactgctgccagggcccaacaaaatgttgcctaaggtcttcttcagcgaaaaatgcaagaagctgctttcacctagtgacgaaatcctgaagattcgtaaaaatggcacgtttaagaaaggcgacaagttttcgcttgatgattgccataagttgatcgacttctataaagagtcatttaaaaagtaccccaactggctgatctacaatttcaagttcaagaacaccaatgagtataacgatattcgtgagttctataatgatgttgcatctcagggatataacattagcaagatgaaaatcccaactagttttatcgacaagctggtcgacgaaggaaaaatttatcttttccagctttataacaaagatttctcacctcatagtaaaggcacacccaatttgcacactttatacttcaaaatgcttttcgacgaacgtaatttagaggatgtggtgtataagttaaacggagaggctgaaatgttttatcgcccagcatctattaagtacgacaaacctactcaccctaaaaacactccaatcaagaataagaacacattgaacgataaaaagactagtacttttccatacgatctgatcaaggataagcgctacactaagtggcagtttagcttgcattttccaattacgatgaacttcaaagcacccgatcgtgcgatgatcaacgatgacgtgcgtaatttgttaaagtcatgtaacaacaactttattatcggtattgatcgcggtgaacgcaacttattgtatgtttcagtcatcgactccaacggggcgattatctatcaacattcgctgaacatcatcgggaacaagttcaaaggaaaaacatacgagactaattaccgcgaaaaattagcaacccgcgaaaaggaacgcacagagcagcgtcgtaactggaaggcgattgagtccatcaaggaactgaaggaaggatatatcagccaggctgtgcatgtaatttgccaattggttgtgaagtacgacgcgattatcgttatggagaagctgactgatggattcaaacgcgggcgcacaaaatttgagaagcaggtctaccagaagttcgagaagatgttgatcgataagcttaactattatgtggacaaaaaactggacccagatgaaggcgggggattacttcatgcttatcaacttacgaacaaactggaatcgtttgacaagttaggaatgcaatccggatttattttttatgttcgtccggatttcacttctaaaattgacccagttacaggctttgtaaaccttctttatccccgttacgagaatatcgataaagcaaaggacatgattagtcgcttcgatgacatcggatataacgcgggggaggacttcttcgaatttgatattgattacgacaaatttccgaaaacagccagtgactaccgtaagcgctggacaatttgtacgaatggtgaacgtatcgaggcgtttcgtaaccccgcaaaaaacaacgaatggagctaccgcactatcattttggcagagaaatttaaggagcttttcgataacaacagcatcaactaccgcgatagcgatgatcttaaggccgaaattttgtcacaaactaaggggaaattttttgaagatttcttcaaactgttacgcttaaccctgcagatgcgtaactctaatcctgagacaggggaggatcgtatcctgagcccggtgaaggataaaaatggtaatttttatgatagttccaagtacgacgaaaaaagcaagttgccttgtgacgccgacgccaatggtgcttataacattgcgcgcaagggactgtggatcgtggagcagttcaagaagagtgataatgtgagcacggtcggcccagtcattcacaatgacaaatggttaaaattcgtgcaggagaatgacatggcgaacaattaa

SEQ ID NO: 834 - DNA, 3846 bp, Prevotella sp.
  source 1..3846: mol_type = genomic DNA
gtgaacattttaaaagagaattatatgaaagaaattaaagaactaacaggcttgtattctttaactaagactattggggtagaattaaagccagtgggtaagacgcaagagctcattgaagctaaaaagcttattgagcaggatgatcagcgtgccgaagattacaaaatagtaaaggatattattgatcgttatcataaggattttatcgataagtgtcttaactgtgttaaaatcaaaaaagatgatttggagaaatatgtgtcattggcagaaaactctaatagagatgctgaggattttgacaaaatcaagaccaaaatgcgtaatcagataactgaagctttcagaaagaattctttatttactaatttattcaagaaaaatcttattaaggagtatcttcctgcttttgtaagtgaggaagagaagagtgtggtgaacaaatttagcaaatttaccacttactttgatgcgtttaatgacaatcgtaaaaatttatattcaggcgatgccaaatccggtacgatagcttatcgacttattcatgagaatttgccgatgtttcttgataatatagcatcctttaatgcaatttctgggataggagtaaatgagtacttttctagtatagagacagaatttactgatactcttgaaggaaagcgtctgactgagttttttcagattgacttttttaataatacattgactcagaaaaagataggcaactataactatattgtaggggcagtcaataaagctgtaaatctttataagcaacagcacaaaacagttcgtgttccattgctcaaaccattatataaaatgatcttgagtgatagagttactccgtcatggttacctgaacgttttgaaagtgatgaagagatgctgactgccatcaaagctgcttacgaatctttgagagaagttttagtaggtgataatgatgaaagtcttcgcaacttattgctcaatatagagcattatgatcttgaacatatttacattgcaaatgattccggattgacttccatttcacagaaaatatttggatgttatgatacttatactttggcaatcaaagaccaactacaaagggattatcctgcaacaaagaagcaaagagaagctcctgatttgtatgatgaacgtatagataaattgtataaaaaggtgggtagtttttctattgcttatcttaatcggttagtcgatgcgaaagggcattttactattaatgaatattataagcagttgggagcttattgtcgtgaagaaggaaaagaaaaagatgatttctttaagcgtattgatggtgcttattgtgctatatcacatcttttctttggggaacatggcgaaatagcccagtcagactcagatgttgagcttatccaaaagttgctcgaagcctataaggggttacaacgctttatcaagcctttattaggtcatggtgatgaagctgataaagacaatgagtttgatgcaaaacttcgtaaagtatgggatgaactcgacatcattacaccgctttatgataaagtacgcaattggctctctcgtaagatatataaccctgagaaaataaagctatgttttgagaataatggcaagttgttatctggatgggttgacagcagaactaaatccgataatggtactcaatatggagggtatatctttagaaagaagaatgaaattggtgaatacgatttctatttgggtatttctgctgatacaaaactgtttcgtcgtgatgctgccatcagttatgatgatggcatgtacgagagattagattattatcagctgaaatcaaaaactttactcggaaatagttatgttggagattatggactggattcgatgaatttgctttctgcatttaaaaatgctgcagttaagttccaatttgaaaaggaagtggttcctaaagataaagagaatgtgccaaaatatctcaagcgcctaaaactggattatgcaggattttatcaaattttgatgaatgatgataaggttgttgatgcttacaagattatgaagcagcatattcttgcgacattgacttcttcgattcgtgtacctgcggcaatagagttagctactcaaaaagaattgggtattgacgaattgattgatgaaataatgaatttaccgtccaagtcattcggctatttccctattgtcactgcagcaatagaagaagctaacaagagagagaataaacctttgtttctttttaagatgagtaacaaggatctttcttatgcagcaacagcttctaaagggttaagaaaaggtcgaggaacagagaatcttcattcaatgtatctcaaagctcttctggggatgacacagagtgtttttgatatcggaagtggaatggtattctttcgtcaccaaactaaaggtttggcagaaacaacggcaagacataaagctaatgagtttgttgctaataagaacaagcttaatgacaagaaaaagagtatttttggctatgagatagtgaagaataaacgttttacggtagataagtacctttttaagttgtctatgaatttgaattattcgcaaccaaataacaataaaattgatgtaaattctaaagttcgtgaaataattagtaatggaggtataaagaatattattggcatagatcgtggtgaacgtaatttactttatctgtctttaatagatctgaagggaaatattgtcatgcagaagtctctcaatattctcaaggatgatcataatgcaaaggaaactgattataaaggtttgctgacagaacgagaaggagaaaataaagaagctcgccgcaattggaagaagatagcgaatatcaaagatttaaaacgaggttatttaagtcaggtagtacatatcattagtaaaatgatggtagaatacaatgcaattgttgtacttgaagatttaaatccaggttttatcagaggcagacaaaaaatcgagcgtaacgtatatgaacaattcgaaagaatgctaattgacaagttgaatttttatgttgacaagcataaaggtgccaatgaaacgggaggtttgttgcatgcacttcagcttacttctgaatttaaaaatttcaagaaaagtgagcatcagaatgggtgtcttttctatattcctgcatggaatactagcaaaatagatcctgcaacaggttttgtcaatctctttaatacgaaatatacgaatgcagttgaggcgcaggagttctttagtaaatttgacgagattcgttacaacgaggagaaagattggtttgagtttgaatttgattacgataaattcactcagaaggcgcatggtacacgtactaagtggacgctctgtacttatggtatgcgtttgcgttcatttaaaaattctgcaaaacaatataattgggattcagaggtagtagcgcttaccgaagaattcaaaagaatacttggagaagcaggtattgatattcatgagaatctaaaagatgcaatctgtaatttggaaggtaaaagccagaagtatctcgaacctttgatgcagtttatgaaattgctgctacaattgcgtaatagtaaggctggtactgacgaagattatatcctttctccagttgctgatgagaatggaatattctacgatagccgttcttgtggtgatcaacttccggagaatgcggatgctaatggtgcttacaacatcgctcgcaagggactgatgctgattgagcaaatcaagaatgcagaggatttgaataacgtcaagtttgatatatccaataaggcttggctcaattttgcacaacaaaagccatataagaatggatga

SEQ ID NO: 835 - DNA, 3846 bp, synthetic construct
  misc_feature 1..3846: note = Description of Artificial Sequence: Synthetic polynucleotide
  source 1..3846: mol_type = other DNA
gtgaacatccttaaggagaactatatgaaagaaatcaaggagttgaccggtctttactcattaactaaaacaattggcgtcgaattaaagcccgtaggaaagacacaagagcttattgaggcgaagaagcttatcgagcaagatgaccaacgcgcggaggattacaaaatcgtaaaggacattatcgaccgctaccacaaagatttcatcgataaatgcctgaactgtgtaaaaattaaaaaagatgaccttgagaagtatgttagccttgctgagaactctaatcgcgacgctgaagatttcgacaaaatcaaaacaaagatgcgtaatcagatcactgaggcgttccgcaagaactctttattcaccaacttgtttaaaaagaatcttatcaaggagtatttgcccgcgttcgtcagtgaagaggaaaaaagtgtggtgaataaattcagcaaatttactacttacttcgatgcgttcaatgataatcgcaagaacctgtactccggtgacgccaaatccggaactattgcataccgtttaatccatgagaatttgccaatgtttcttgataatatcgctagctttaatgccatttcgggcatcggagtgaacgagtacttctccagcattgagacagagtttactgacacgctggaagggaagcgcctgaccgagttctttcaaatcgacttttttaacaacactctgacccagaaaaagattggcaactataactacattgtcggtgccgtcaacaaagccgtgaacttgtataagcagcaacacaaaacggttcgtgtcccgttgttgaagcccctgtataagatgattttgagtgaccgcgtaacgcctagctggctgcccgaacgtttcgaatctgacgaagaaatgttgaccgctattaaagctgcttacgagagccttcgtgaagtactggttggagacaatgatgaatcattgcgtaatcttctgcttaacattgaacattatgatttggaacacatttatatcgcaaatgatagtggcctgaccagtatcagtcagaagatttttggatgctacgatacatatactcttgccatcaaggaccagcttcagcgtgactatccagctactaaaaagcaacgcgaggcacctgatctttacgatgaacgcatcgataagttatacaaaaaagtaggttctttctcaatcgcctatctgaatcgtttagtggatgcgaaaggacactttactattaatgaatactacaagcaattaggggcatattgtcgtgaggagggcaaagaaaaagacgatttttttaaacgcattgacggggcctactgcgccatttcacatctgttctttggtgagcacggggaaattgcccaatctgacagtgatgtggaacttattcagaaattattagaagcctacaaggggcttcagcgttttattaaaccattacttgggcatggggatgaggctgacaaagataacgaatttgacgctaagcttcgcaaagtatgggacgagcttgacatcattacccctttatacgataaggtacgcaattggttgtcccgcaagatctataacccagagaagattaaattatgtttcgaaaataatggcaaactgctttcaggctgggttgacagtcgcacgaagtcagataacggtacgcaatatgggggatacatttttcgcaaaaagaacgagatcggggaatatgatttttatttgggtatttccgccgatactaagctgtttcgtcgcgatgcggcaatcagttacgatgacgggatgtatgagcgtctggactactatcagttgaaatccaagactcttttaggcaattcgtacgtaggcgattatggacttgactcgatgaacttattgtctgcatttaaaaacgcggcggttaagtttcaattcgagaaagaggtcgtcccgaaagataaagagaacgttccaaaatatttaaaacgtcttaagttagattatgcgggattctatcagattcttatgaacgatgacaaggtcgtggatgcatataaaattatgaaacagcacatccttgctactttaacgtcatcgattcgcgtgcctgctgctatcgaacttgccacccaaaaagagttgggaattgatgagcttatcgatgagattatgaatctgccttcaaagagttttggctacttcccaatcgtcaccgcagcgatcgaagaagctaataaacgtgaaaacaaaccgttattcttgtttaaaatgtccaacaaggacctttcctacgcagcaacggcctccaaaggacttcgcaagggacgtggaaccgagaacttacatagcatgtatcttaaagccttgttgggaatgacccaatcagtgtttgatattggtagcggtatggtgttctttcgccaccaaaccaaagggctggctgaaactactgcccgccacaaagcgaatgaatttgtagctaataaaaataagttaaatgataaaaaaaagtccatctttggatatgaaattgtgaagaataaacgcttcacggtagataaatatctttttaagttgtctatgaaccttaactacagccaaccaaacaacaataagatcgatgtgaattctaaagttcgtgaaatcatttcgaacggaggcattaaaaacatcattggtatcgaccgcggagaacgtaatcttctgtaccttagcttgattgacttaaaaggcaatattgtgatgcaaaagtcacttaatatcttgaaagacgaccacaacgcaaaggagaccgattacaaaggactgcttactgaacgtgaaggtgagaacaaagaggcacgccgcaattggaaaaaaattgctaacatcaaggatttaaaacgtgggtacctgtctcaggtagttcacattattagcaaaatgatggtcgaatacaatgcgattgttgtgttagaggatttaaaccctggcttcattcgtggtcgtcaaaaaatcgaacgcaatgtctacgaacaatttgaacgtatgttgatcgataagctgaatttttacgtggataagcacaaaggggccaacgaaaccgggggacttttacatgcgttacagttgacttctgaattcaaaaattttaagaaaagtgagcaccagaacgggtgcttgttctatattcccgcctggaatacaagcaaaatcgatcctgctacggggtttgtaaatttgttcaataccaaatatacaaatgctgttgaggcgcaagaattcttttccaaattcgatgagatccgttacaatgaagagaaagactggttcgagttcgaatttgattatgataagttcacgcaaaaggcccacgggactcgcacaaagtggactttgtgtacgtacggaatgcgccttcgttccttcaagaacagtgcaaagcaatacaactgggatagcgaggtagtagcattaaccgaggaatttaaacgtattttaggcgaggcaggtatcgatatccatgagaatttaaaggacgcgatctgtaacttggagggtaagtctcagaagtatctggaaccgttaatgcaattcatgaaattattactgcagctgcgcaattccaaagccggaactgacgaggattacattttaagcccggtagccgatgagaacggaatcttctacgatagtcgttcttgtggagatcaacttcctgaaaatgcagatgcgaacggagcatataatatcgcccgcaaaggcttaatgctgattgagcaaattaagaacgcggaggaccttaataacgtaaaatttgatatctcgaacaaggcgtggttgaacttcgctcagcaaaaaccttacaaaaatggctga

SEQ ID NO: 836 - DNA, 3846 bp, synthetic construct
  misc_feature 1..3846: note = Description of Artificial Sequence: Synthetic polynucleotide
  source 1..3846: mol_type = other DNA
gtgaacatcttaaaagaaaactacatgaaggagatcaaagagctgaccggtttatattcgttaactaagacgatcggagttgaacttaaacctgtgggaaaaactcaggagcttattgaggcaaaaaagttgattgagcaagatgatcagcgtgctgaagactacaagattgttaaggatatcattgaccgctatcataaggatttcatcgacaaatgccttaattgtgtcaaaatcaagaaggacgatttggagaaatacgtatcacttgcggaaaacagtaatcgtgacgcagaagatttcgataagattaagacgaagatgcgcaatcagatcacggaggcatttcgcaaaaattccttgtttaccaatttgtttaaaaagaacctgattaaagaataccttcctgccttcgtatcagaggaagagaagtctgttgtaaacaagttcagtaaattcaccacgtactttgacgcttttaacgataatcgcaaaaacctttactccggtgacgccaaatcgggcactatcgcctatcgcttaatccacgaaaatctgccgatgtttctggataatatcgcctcgttcaatgccattagtggaattggtgtcaatgaatacttcagcagtattgaaactgagtttactgatacccttgaaggcaagcgccttaccgaattcttccagattgatttttttaataatacgctgacccagaaaaaaatcgggaattacaactatatcgttggagccgtcaataaggcagtaaatttgtataagcagcaacacaagactgtgcgtgtaccgcttttaaaaccattatacaaaatgattcttagcgaccgcgtcacgccctcatggctgcccgagcgctttgagagtgatgaggaaatgctgacagcgattaaggcagcctatgagtcgctgcgcgaggttcttgttggcgacaacgatgagagcttacgtaacttattacttaatattgagcattatgatttagaacacatctatattgctaatgactcaggccttacaagcatctcgcagaaaattttcggatgctacgatacctataccttggctatcaaagaccaattgcagcgtgattatcctgcgactaaaaagcaacgtgaagcccctgatttatacgacgagcgtatcgataagttgtacaaaaaggtggggagtttttcaattgcctaccttaatcgccttgttgatgcaaaaggacacttcaccatcaacgaatattacaagcagcttggggcctactgtcgcgaagaaggtaaagagaaagatgacttttttaagcgtatcgacggagcgtactgtgcgatcagccatcttttttttggtgagcatggtgaaattgctcagagtgattccgatgttgagctgatccagaaacttcttgaggcgtataaagggcttcagcgttttattaaacctcttttgggtcacggcgacgaagcggacaaagataacgagttcgacgcgaagcttcgcaaggtgtgggacgaattagacatcattacccctctgtatgataaggttcgtaactggcttagtcgcaagatttataatcccgagaaaattaaattgtgctttgaaaacaacggcaaattattatccggctgggttgattcccgcaccaaatccgacaatgggacgcaatatggtggctatattttccgcaagaagaatgagatcggggaatacgatttttatttaggaatctccgcagatacaaagttgttccgtcgtgatgccgctatcagctacgatgacgggatgtatgaacgccttgattattatcaattaaaatcgaagacgcttttgggtaattcttatgtcggcgactatgggttggattccatgaaccttttatcagcgttcaaaaatgctgctgtgaagtttcaattcgaaaaggaggtggtgcccaaggataaagagaacgttcccaaatatctgaagcgccttaagttagactacgccggtttttatcaaattttgatgaacgatgataaggttgtggatgcttataaaatcatgaagcaacacatcctggcaactctgactagttctattcgcgtaccggcagcaatcgaacttgcaacccagaaggagttaggaattgacgaattgatcgacgagatcatgaatcttccctccaagagtttcggatactttccaatcgtaacagccgccatcgaggaggcaaataagcgtgagaataaacctctgttcctgttcaagatgtcgaataaggacttatcatacgccgccacggcaagtaaaggtcttcgcaaagggcgtggcacggaaaacctgcatagcatgtatttgaaggcattgctggggatgacccaaagtgtttttgacattggctcaggtatggtatttttccgccaccagacaaaaggactggccgagacaacggcgcgtcacaaggcaaacgaatttgtcgctaataagaataaactgaatgataagaagaagtcgattttcggatatgagatcgtcaaaaacaagcgcttcacagtggataagtatttgtttaagttatcaatgaaccttaactactcgcaaccgaataataacaaaattgacgtaaacagcaaagtccgcgaaattattagcaatggcggcattaagaacatcatcggaatcgaccgcggtgaacgcaacttattatatttatcattgattgatctgaaaggaaatattgttatgcaaaaatctttgaatattttgaaagatgatcataatgccaaggagaccgattataaagggcttctgaccgagcgcgagggggagaataaggaggcacgccgcaactggaagaaaattgccaatatcaaggatcttaaacgtggttacctttcacaggtagtccatattatcagcaagatgatggtcgagtacaacgctattgtagttttagaggaccttaacccggggttcattcgtgggcgccagaaaatcgaacgtaatgtatatgaacagttcgagcgtatgctgattgacaagcttaacttctacgtggataagcataagggtgccaatgagaccggaggtcttctgcatgccttgcagttaacatcggaattcaagaactttaaaaagagtgaacaccaaaacggatgcttattttatatccctgcatggaatacgagcaaaatcgaccccgccacgggattcgtaaatctgtttaacaccaagtatacgaacgcagttgaggctcaggagttcttttcgaagttcgatgagattcgttacaatgaagaaaaagattggtttgaatttgagtttgactatgataagttcacgcagaaggcgcatggtactcgtaccaaatggaccctttgtacttacgggatgcgcttgcgctcgtttaagaacagtgccaaacaatacaattgggacagcgaggtagtcgccttaacggaagaatttaagcgtattttaggagaagccggcattgacattcacgaaaacctgaaggacgcgatttgtaacttagagggcaagtcgcaaaaatatttggaacctcttatgcagtttatgaaacttcttttacaattgcgcaattcaaaggctggaactgacgaagattatattttatctcccgtcgccgacgaaaatggtatcttctacgactcccgctcctgtggcgatcaattacccgagaacgccgatgctaatggggcttacaacattgcgcgtaaaggcttgatgctgattgagcagatcaagaatgctgaggacttgaacaacgtcaagttcgacatttcaaacaaggcttggctgaacttcgcacagcaaaaaccatacaagaatggctga

SEQ ID NO: 837 - DNA, 3846 bp, synthetic construct
  misc_feature 1..3846: note = Description of Artificial Sequence: Synthetic polynucleotide
  source 1..3846: mol_type = other DNA
gtgaacatcttaaaggagaattatatgaaagagatcaaggagcttacagggctttactcactgacgaaaacaattggggttgaattaaaaccggtaggaaaaacacaagagcttatcgaagcgaaaaaattgatcgaacaggacgaccagcgcgcggaagattacaagatcgtaaaagacatcatcgaccgttaccacaaagatttcattgataagtgcttaaactgtgtaaagatcaaaaaggatgatcttgaaaaatatgtgtcacttgcagagaattccaatcgcgacgcagaggatttcgataaaattaaaaccaaaatgcgcaaccagattacagaagcgtttcgtaaaaattctttgtttacaaatttgtttaaaaaaaatcttattaaagagtacctgcctgccttcgtctccgaggaagagaaatctgttgtaaataagttcagtaagtttacaacgtactttgatgctttcaacgacaaccgcaaaaatttatatagcggggacgcaaaatctgggacgattgcatatcgcttgattcacgagaacttaccgatgtttctggataacattgcatcctttaatgccatttccgggatcggagtaaatgagtattttagcagcattgagacagagtttactgatacgctggaggggaaacgtcttactgagttcttccaaatcgacttctttaacaacacccttactcagaaaaaaatcgggaactacaactatattgtcggcgctgtgaacaaggcggtcaatttgtataagcagcagcataaaacggtccgtgtccctctgttgaagccgctttataaaatgattctgtcagaccgcgttactccctcatggcttcctgagcgctttgagtcggacgaagaaatgcttacggcaatcaaagcagcctatgaatcattacgtgaggttttggtcggtgataacgacgaaagccttcgtaacttgcttttaaatatcgagcattacgatttggagcacatctatatcgcgaacgattcgggattaacttctatctcccaaaagatttttggctgttatgacacgtatactctggccattaaggatcagcttcaacgtgactatccggccactaaaaagcaacgcgaggctccggacctgtacgatgaacgcatcgacaaactttacaagaaagtgggctcgttctcaattgcttaccttaaccgtcttgtcgacgcgaaaggacactttacgattaacgaatattataagcaacttggggcgtattgtcgcgaagagggcaaagaaaaggacgattttttcaagcgcattgatggagcttactgtgcgatttcgcaccttttctttggcgaacatggggaaatcgcgcaatcagactcggacgtcgaactgattcagaaattattagaggcgtacaaagggctgcagcgttttattaaaccattattagggcatggagatgaagcggacaaggacaatgaatttgatgccaaacttcgtaaagtctgggatgaacttgacatcattacgccgttatatgataaggtccgcaattggctttcccgcaaaatctataaccccgaaaagatcaagctttgctttgagaataacggtaagttattgtcagggtgggtagattctcgtactaaatcggacaacggcacacagtatggaggctacattttccgtaaaaagaacgaaatcggcgagtatgacttctatctgggaatttcagcagacacgaaattattccgtcgtgacgcggccatctcatacgatgatggtatgtacgagcgcttggattactatcaactgaaaagcaaaaccttactgggcaatagctatgtaggtgattacggattggacagtatgaacttgttgagtgcttttaaaaatgcggcggtaaagttccaatttgaaaaggaagtggtaccaaaagacaaagagaacgttccgaagtaccttaaacgccttaaattggactacgcgggattttaccaaatcttaatgaacgacgataaggtcgtggacgcttacaagattatgaagcaacatatccttgccaccttgacgtcttcgatccgcgttcctgcagcaattgaattggcaacccagaaagagcttggcatcgatgaacttatcgatgaaatcatgaatttaccaagtaagagttttggatactttcctattgtaaccgcggctattgaagaggccaacaagcgtgagaacaaaccgcttttcttgtttaaaatgagtaacaaagatcttagctatgcggcaacagcatctaaggggttacgcaagggtcgcggcacggaaaatttacactcaatgtatttaaaggcgctgcttgggatgacccaaagtgtctttgacattgggtctggtatggtttttttccgtcaccagaccaaaggcttagcggagactacggcacgtcacaaggctaacgagttcgtagcgaacaaaaataagttaaatgacaaaaagaaaagcattttcggatacgagatcgtcaagaataagcgcttcaccgtcgataagtacctgttcaaattgagtatgaacttaaattatagccagcccaacaataacaaaatcgatgtgaacagcaaagttcgtgagattattagtaatggcggcattaagaacattattggtattgaccgcggtgaacgtaatttgctgtacctgtctcttatcgatttgaaggggaacattgtcatgcaaaaatccctgaacatcctgaaagatgaccataatgcgaaagaaactgactacaagggtcttttaacagagcgtgaaggcgagaataaagaggcgcgtcgtaactggaagaaaatcgcaaatattaaggatttgaaacgtgggtatctgagccaagttgttcacattattagcaaaatgatggttgaatataacgcgattgttgtactggaagacctgaacccagggttcatccgcggacgtcagaaaatcgagcgcaatgtctacgaacaatttgagcgtatgttaatcgacaaattgaacttttacgtggataaacataaaggagcgaacgagacagggggcttgctgcatgcgctgcagttaacgtctgagttcaagaactttaaaaagagcgaacaccaaaacggctgtcttttctacatccccgcttggaatacgtccaagattgatccagcaaccggtttcgtaaacttgtttaacaccaagtataccaacgccgttgaagctcaggaattcttcagtaagttcgacgaaatccgctataatgaagaaaaagactggtttgagtttgagtttgattatgataagttcactcagaaagctcatggaactcgtaccaagtggactctgtgcacgtacgggatgcgcttacgcagcttcaagaactcagcaaagcaatataactgggactccgaggtagttgccttgaccgaggaatttaagcgcatccttggcgaggcaggaatcgatatccacgagaaccttaaggatgcgatctgcaacttggaggggaaatcgcaaaaatacttggaacctttgatgcagtttatgaagttacttctgcaattgcgtaactcgaaagccggaactgacgaagactatattctgagtccagtcgctgatgaaaatggtattttttatgactcccgttcctgcggagaccaattacccgagaatgctgacgcgaatggggcgtacaatattgctcgcaagggccttatgcttattgagcagatcaaaaacgcagaggaccttaacaacgtaaaattcgatatcagcaataaggcgtggctgaactttgcccaacaaaagccctacaagaacggctga

SEQ ID NO: 838 - DNA, 3882 bp, unidentified
  misc_feature 1..3882: note = Description of Unknown: Parcubacteria group bacterium Gr01-1014_33 sequence
  source 1..3882: mol_type = genomic DNA
atggcaaaagagaatatttttaatgagctcacaggaaaataccagctttcaaaaacgttgagattggagttgaagccagtggggaacactcagcagatgcttaaagatgaagatgtctttgaaaaagatagaattatcagggagaagtatagagagacaaggccgcattttgatcgtttacatagagagtttattgaacaggcgcttaaaaatcagaaactttctgatttaggaaagtattttcaatgtctcgcaaaactccaaaacaataaaaaggataaagaagcgcaggaggaatttaaaaggatttctcaaaatttaagaaaagaagtcaatgatctatttaaaatagatccgctgtttggggaaggagtctttgctttgctaaaagaaaaatatggcgaaaaagacgatgctttcttaagggagcaagatggtcagtatgttcttgatgaaaataaaaagaagatatcaatctttgattcatggaagggatttacggggtatttcacaaaatttcaagagacaagaaaaaatttctacaaagatgatggtactgcgacggcagttgccacaaggatcatagaccaaaatctgaaaagattttgcgagaatattcaaatatttaaatccatacaaaaaaaagttgattttaaagaagttgaagataatttttcggtagatttagaagatatcttttctcttggtttttatagttcttgttttctccaggaaggaattgatgtgtataacaaaattctaggaggtgaaccaaaaacaacaggtgaaaaattaaggggattgaatgaattgataaacagatatcgccaggaccataagggcgaaaaattgccgtttttcaagatgcttgataaacagattttaagcgagaaagaaaaattcattgaaagtatagaagacgacgaagaacttttaaaaactctaaaggaattttattcttctgcggaagaaaagactacagtattaaaagagcttttcaatgactttattaaaaacaatgagaactatgatctttccgaaatctatatttccagagaagcactcaatactatttcgcaccgttgggtaagtgccgctacgctacctgaatttgaaaaaagtgtttacgaagtgatgaaaaaggacaaaccatcagggcttagttttgacaaggacgataactcttataaatttcctgattttatcgcgctctcttatataaagggatcgtttgaaaaattatccggagaaaagctatggaaagatggatattttagagacgaaacaagaaatggtgataaaggttttttgatcggcaatgaatccctttggactcaattcataaaaatatttgagtttgaatttaattctttatttgaggcaaaaaataccgaaagatccgttggttattatcatttcaaaaaagattttgaaaaaataatcaccaatgatttttctgtaaatccggaagataaagtaattatcagagaatttgccgataatgtgctggccatttatcaaatggcaaagtactttgccattgaaaagaaacggaaatggatggatcaatacgatacgggtgatttctacaatcatcctgactttggatacaagacaaaattttatgacaatgcctacgaaaagatagtaaaggcgagaatgttactgcaaagttatctcactaaaaaaccatttagcacggataagtggaagttaaattttgaatgcggatatcttcttaatggatggtcttcaagttttaacacctatggttcgcttttatttagaacgggcaatgaatactatttgggagttgtgaatggtagtgccttgcgaacagagaaaatcaagagactaacaggcaatataacggaggcaaattcttgtcataaaatggtttatgattttcaaaaaccggacaataaaaatgtaccaagaatatttattagatcaaagggtgataaatttgcaccagcggtctccgagttgaatcttcctgttgattcaatattagaaatatacgataagggtttgtttaaaacagaaaataaaaatagtccgttttttaagccatcacttaaaaagcttattgattacttcaaattgggattcagtcgccatgcatcctataagcactatcagtttaaatggaaggatagttctgaatataaaaatatatctgaattttataatgataccattcggtcttgctatcagatcaagtgggaggagttaaattttgaagaagttaaaaaacttaccaactcaaaagacttattcttattccaaatatataataaagatttttccgaaaaaagtactggaaataagaatcttcattccatttattttgatggtctattcttggataataatatcaatgcgcaagacggagtgatccttaaattaagtggtggcggagagatttttttccgaccaaagacagatgtcaagaaacttggtagcaggactgatactaaaggaaagcttgttataaaaaataagagatatagtcaagataaaatctttttacattttcctattgagctaaactattctaatactcaagagagtaattttaacaaattagtaagaaatttcctcgccgataatcctgatataaatattatcggtgttgatcgtggagagaaacatttgatttactacgcgggaattgatcaaaaaggaaataccttaaaagataaagacgataaagatgttttggggagcttgaatgagatcaatggcgtaaattactataagttattggaagaaagggcaaaggcgcgggaaaaggcccggcaggactggcagaatattcaaggcattaaagatttaaaaatgggctatatttctcttgtggtgagaaaattagctgatttgattattgagtataatgctattctcgtgcttgaagacttgaatatgcgatttaagcaaattcacggcgggattgaaaagagcgtgtatcaacagcttgaaaaagcgctcattgaaaaattaaatttcttagttaataaaggcgagaaagatccagagagggcggggcatttgctccgtgcgtatcagctgaccgcaccgtttagtacgtttaaggatatgggcaaacaaaccggcgtgctgttctacacgcaagccagctacacatcaaaaacgtgccctcaatgcggttttcgtccgaatattaaattgcattttgataatcttgagaacgcaaagaaaatgcttgagaagataaatattgtctacaaagataatcactttgaaattggctataaagttagtgatttcaccaagacagaaaagacaagtagagggaatatactatatggagacaggcagggcaaagacacctttgttatttcttctaaagcggcaatccgttataaatggtttgccagaaatataaaaaacaatgaactgaatagaggagaaagcttgaaagagcatacagaaaaaggagtaacaattcaatacgatattaccgaatgtttaaaaattctctatgagaaaaatgggatagatcattccggcgatataacaaaacaatcaatacggagtgaattgccagcaaaattttataaagatttactattctatttgtatttattgacgaatacaagaagcagtatctctggcacagaaatagattacataaattgccctgattgcggttttcatagcgagaaaggtttcaatggatgtatatttaatggagatgcaaatggtgcatacaatattgccagaaaaggtatgttaatactaaaaaagataaatcagtacaaagatcaacatcacacaatggacaagatggggtggggcgatttatttatcggtatagaggagtgggataaatatacgcaggttgtgtcaagatcataa

SEQ ID NO: 839 - DNA, 3882 bp, synthetic construct
  misc_feature 1..3882: note = Description of Artificial Sequence: Synthetic polynucleotide
  source 1..3882: mol_type = other DNA
atggcgaaggagaacatctttaacgagcttaccggaaaatatcaactgtcgaaaactctgcgcttagaattaaaacctgtcggaaatactcaacaaatgttaaaagacgaagacgtgttcgaaaaagatcgtatcattcgcgaaaaatatcgtgagacccgtccccatttcgatcgtctgcatcgtgagtttattgaacaagcgctgaagaatcaaaaactttccgaccttggaaagtattttcagtgcttggctaagttgcaaaacaataaaaaggacaaagaggcacaagaagagtttaaacgcatttcgcagaatttgcgcaaagaagtcaatgatttattcaaaattgatccgttattcggcgagggtgtatttgcactgctgaaagaaaagtatggagaaaaagacgatgcctttctgcgcgagcaggacggccaatatgttttagatgagaataaaaaaaagatttccatttttgatagttggaagggctttacagggtatttcacgaaattccaggaaactcgtaagaacttctacaaagacgacgggacggcaacagcggtggctacacgtattatcgaccaaaatcttaagcgcttctgtgagaacattcaaatctttaagtcaatccagaagaaggtagactttaaggaggtcgaggacaacttctcagtcgatttagaagacatcttctctttagggttttactcttcttgtttccttcaggagggcatcgacgtatacaataagattctgggtggtgagccaaagactactggagaaaagcttcgtgggttgaacgagttgatcaatcgctatcgtcaggatcacaagggggagaaattgcctttttttaagatgctggacaagcagattctgtccgagaaagagaagtttatcgaaagcattgaagatgatgaggagctgttgaagaccttgaaggaattctatagtagtgccgaagaaaagactactgttctgaaagaacttttcaatgactttatcaaaaacaacgaaaactacgaccttagcgaaatctacatttctcgcgaagctctgaatacgatctcgcaccgctgggtgagtgcagccacacttccagagtttgagaaatccgtttatgaggtcatgaagaaggacaagccaagtggcctttccttcgacaaggacgataattcttataaatttcctgactttattgcgctttcgtacatcaaaggttcttttgagaaattaagcggagagaaactttggaaggatggctactttcgcgacgaaacccgcaacggtgataaaggatttcttatcggtaatgaatcattgtggactcaattcatcaagatttttgagtttgagtttaactcgttattcgaagccaagaacacggaacgttctgtggggtactaccattttaaaaaagattttgaaaaaattatcactaacgacttctccgtgaaccccgaagacaaagtgattattcgcgaatttgccgacaatgttcttgcgatctatcagatggccaaatactttgcgattgagaagaaacgcaagtggatggatcagtatgataccggcgacttctacaatcatccagactttggctacaaaaccaaattttatgacaatgcatacgaaaagatcgtcaaggcacgcatgcttttgcagtcatatttaacgaagaaacctttttcaactgataagtggaagctgaacttcgaatgtggctatcttttaaatggttggtcaagcagcttcaatacatacgggtcgttacttttccgtaccggtaatgaatattatttgggcgtcgtaaacggatccgccttacgtactgagaaaattaaacgtttaaccggaaatatcaccgaggcaaattcatgccataagatggtctacgatttccaaaaacccgataataaaaatgtccctcgcatcttcattcgttctaagggcgacaagtttgcccctgccgtatccgaattgaatttgccagttgattcaatcttagagatctatgacaaaggcctgttcaagaccgaaaacaaaaactccccattttttaaaccttcgcttaaaaaattgatcgactacttcaagttgggcttctcgcgtcacgcttcctataagcattaccaattcaagtggaaagattctagcgaatacaaaaatattagcgaattctataatgatacgattcgttcatgctatcagatcaaatgggaagagctgaatttcgaagaagtaaagaaattgaccaactcaaaggacctgttcttgttccagatctacaataaagatttctcagaaaagtccactggaaacaaaaacctgcacagtatctatttcgatggcttgtttcttgataataacattaacgctcaagacggcgtgattttgaaactgtccggtgggggagagattttttttcgccccaaaacggacgttaaaaagttaggctcccgcacggacaccaaaggaaagctggttattaagaataagcgctactcgcaagacaagatcttcttgcattttcctatcgagttaaactactcaaatacgcaagaatccaactttaataaactggtgcgtaattttctggccgataatccggatatcaatattattggtgtagatcgtggagagaaacatcttatctattatgcggggatcgaccagaaaggaaatacactgaaggacaaagatgacaaagatgtgttgggcagcttgaatgagatcaacggggttaattattacaaattacttgaagaacgcgcgaaagctcgcgaaaaagcccgccaagactggcagaacattcaaggtatcaaagaccttaagatgggctatatttcgttggtggtccgcaaactggcggatcttattatcgaatacaacgccattctggttttggaagacctgaacatgcgcttcaagcagattcacgggggaatcgaaaagtcagtatatcaacagcttgagaaagccttgatcgagaaattgaacttccttgtcaacaagggagagaaggaccccgaacgtgcggggcatcttctgcgcgcttatcaacttacagcccctttctccacctttaaggacatggggaagcagacaggcgtattgttctacacccaggcaagctatactagcaagacttgtcctcagtgtgggttccgtccgaatatcaagttgcactttgacaatttggagaatgccaagaaaatgcttgaaaaaatcaacattgtgtataaggataaccactttgaaattggatataaggtaagcgactttaccaagaccgagaagacttcccgcggtaacatcttgtatggtgatcgccaagggaaggacacttttgtgatcagttcgaaagctgctattcgttataagtggtttgctcgcaacatcaagaacaatgagttaaaccgtggggaatcgcttaaagaacataccgagaagggtgtcaccattcagtacgatatcacggaatgtcttaaaatcctttatgaaaaaaacgggatcgaccattccggtgatatcaccaaacaatctatccgctcggaacttcctgccaaattctataaggatcttcttttctacttgtaccttcttacgaacactcgctcttcgatttccggcaccgaaatcgactacattaattgtccggactgtggattccactcagagaagggttttaacggctgcatttttaatggtgacgccaacggagcatataatattgcccgcaaaggaatgcttattcttaaaaaaatcaaccaatataaagatcagcaccatactatggataaaatggggtggggtgatcttttcattgggattgaagaatgggacaagtatacgcaggttgtcagccgctcttaa

SEQ ID NO: 840 - DNA, 3882 bp, synthetic construct
  misc_feature 1..3882: note = Description of Artificial Sequence: Synthetic polynucleotide
  source 1..3882: mol_type = other DNA
atggcgaaagaaaatatctttaacgaacttacaggaaaataccagttaagtaagacacttcgcctggagttgaagcctgttggaaatactcaacagatgttgaaagacgaagacgtatttgaaaaagatcgtattatccgcgagaaataccgtgaaacccgtccccattttgaccgtttacaccgtgagttcattgagcaagctttgaagaaccaaaagttgtctgaccttggtaaatactttcagtgccttgcaaaactgcagaataataaaaaggataaagaggcccaagaggaattcaagcgcatttctcaaaatttacgtaaggaagtcaacgatttgtttaaaatcgacccgctgttcggagaaggagtgtttgctttgttgaaagagaaatatggagaaaaggacgatgccttccttcgcgaacaggatggtcagtatgtgttagacgaaaacaagaagaaaatttctatctttgattcctggaaaggctttacaggatacttcacgaaatttcaggaaacccgcaagaacttctacaaggatgatggaactgctaccgctgtggcaacccgtattatcgaccaaaatctgaagcgcttctgtgaaaacattcagattttcaagtctattcagaagaaagttgatttcaaggaagttgaggacaatttttcggtagatttagaagacattttctcgttaggcttctacagctcgtgtttcttgcaggaaggtatcgacgtatataacaaaattcttggaggagaaccgaaaacaacgggggagaaactgcgcggtctgaacgaattaattaaccgctaccgtcaggaccataagggagagaaactgcccttttttaaaatgcttgacaagcaaattctttctgaaaaagagaaatttattgagtcaattgaggacgacgaagagttattgaagactttaaaggagttctattctagcgccgaagagaaaactacagtgttgaaggaacttttcaacgattttattaagaataacgagaactacgacttatcggagatttacattagccgtgaagcgcttaataccattagccatcgctgggtgagcgctgccacacttccggaatttgagaagtcggtgtacgaagtcatgaaaaaggacaaaccttccggtcttagttttgataaagatgacaattcctataaattccccgattttattgctttgagctatattaaggggtcgttcgaaaaactttctggagaaaagctgtggaaggatggatactttcgcgatgaaacgcgtaacggtgacaaggggttccttatcggcaatgaatccttgtggactcaatttattaagatttttgagttcgagttcaattcactgttcgaagccaaaaatacagagcgctctgtggggtattaccatttcaagaaagacttcgagaaaattatcacaaacgacttcagtgtcaaccctgaagataaggtgattattcgtgaattcgcggataatgtactggcaatctaccagatggccaagtatttcgctattgaaaaaaaacgtaaatggatggaccaatacgatacaggtgatttttataaccatccagactttggctacaagacgaaattttatgacaacgcgtatgagaagattgtaaaggcacgtatgttattacagagttaccttaccaagaagccgttctccacggataagtggaagttaaacttcgagtgcggctatttgcttaacggatggagttcatctttcaatacgtatgggtcgcttttatttcgtacaggtaatgaatactaccttggcgttgttaacgggtctgcgctgcgtacagagaagatcaagcgccttacaggtaacatcacagaagccaattcttgtcataaaatggtttatgactttcaaaagccggacaacaagaacgtgccccgtatttttatccgttccaagggagacaagtttgcaccggcggtgtccgagctgaacttgccagttgatagcattcttgagatctacgacaagggtcttttcaaaacagaaaacaaaaacagtcccttcttcaaaccaagtcttaaaaagttgatcgactattttaaacttggcttttcccgccatgcttcatataaacactatcaatttaaatggaaagatagctctgagtacaagaatatttctgagttctacaatgacacgatccgtagctgctaccagattaagtgggaagagttaaattttgaagaagtcaaaaagttaacgaatagtaaagatttgttcttatttcaaatttataacaaagatttcagcgaaaagtctaccggaaataagaacctgcactctatctattttgacggcctgtttctggataataacattaatgcacaggatggagtgattttgaaattaagcggagggggggaaatcttcttccgcccgaagacagacgtgaagaagctgggcagccgcactgatacaaaaggtaaattggttattaagaacaaacgttattcacaagacaaaatctttctgcacttccccatcgagttgaactactctaacacacaggagtctaatttcaataagcttgtgcgtaattttctggcagataatccagacattaatattatcggggtggaccgcggagagaagcatcttatttactatgcaggaatcgaccagaaaggaaatacgttgaaggataaggacgataaagatgtattgggctctcttaatgagattaacggcgtaaactactacaaactgcttgaggagcgcgctaaagctcgcgaaaaagcccgccaggactggcaaaatattcaagggatcaaagacttgaagatgggctatatcagtttggtagtccgcaagctggcagacttaattatcgagtataacgcaattctggtattagaagacttgaatatgcgctttaaacaaattcacggtggaattgagaagtcagtctaccaacaactggagaaggccctgatcgaaaaactgaactttctggtaaataagggggaaaaagaccctgagcgtgctgggcatcttttgcgcgcatatcaactgaccgctccttttagcacgtttaaggatatggggaagcagaccggggtactgttctatactcaggccagttatacatctaaaacgtgcccccaatgtggatttcgccccaacatcaagttgcactttgataacttggaaaatgcgaagaagatgttggagaaaattaatattgtatataaagacaaccattttgagattggctacaaggtgagtgattttactaagacagaaaaaacatcccgtggtaacatcttatatggagatcgccagggaaaagacactttcgtcatttcttctaaagctgctattcgttataaatggtttgcacgcaatattaaaaacaacgagttgaaccgcggtgaatccttgaaggagcatacggagaagggcgtcacgattcagtatgatattactgagtgcttgaaaatcctttacgaaaaaaacggcattgaccacagtggtgacatcaccaaacagagcatccgcagtgaattgccggctaagttttataaagatcttctgttctatttataccttttaactaatacgcgttcgtccatcagcggtaccgagatcgattatattaactgtccggattgtggtttccattctgagaagggatttaacgggtgcattttcaatggtgacgcaaatggcgcttataatattgctcgcaaggggatgcttattttaaaaaagattaatcaatacaaggatcagcatcatacaatggacaagatgggttggggtgaccttttcattggtatcgaggaatgggacaagtatactcaagttgtgtcgcgcagctaa

SEQ ID NO: 841 - DNA, 3882 bp, synthetic construct
  misc_feature 1..3882: note = Description of Artificial Sequence: Synthetic polynucleotide
  source 1..3882: mol_type = other DNA
atggcgaaagagaatatttttaacgaattaacaggcaagtaccaacttagcaaaaccttacgtctggaactgaaaccggtaggaaacacgcaacaaatgttgaaagacgaggatgtcttcgagaaggatcgcattattcgcgagaaatatcgtgagacccgtccacatttcgaccgcttacatcgtgagtttatcgaacaagcgcttaagaaccaaaagttgtctgatttgggcaaatatttccaatgcctggcaaaattgcaaaacaataagaaggataaagaagcgcaagaagaattcaaacgcatttcacaaaatctgcgcaaggaagtaaatgacctgttcaagattgacccattattcggtgagggtgtattcgcattattaaaggaaaaatacggtgaaaaggacgacgcgttcctgcgcgagcaagacggccaatacgtattggacgaaaataagaagaagatttctatttttgattcttggaaagggtttaccggttacttcacaaaattccaagaaacacgtaaaaacttctataaggacgacgggaccgcaacagcagttgcgacacgtatcattgatcagaatctgaaacgcttttgcgagaatatccaaatcttcaaaagcattcagaagaaagtagattttaaagaggtcgaagacaacttcagcgtcgacttggaagacattttttccttggggttctacagctcgtgtttcttacaggaagggatcgacgtatataacaagattttagggggggaaccaaaaactacaggggaaaaattacgtggtttaaatgaactgattaaccgttaccgtcaggatcataagggtgagaagctgcccttcttcaagatgcttgacaagcaaattttatctgagaaggaaaaattcattgagtctattgaagacgatgaagaacttcttaagacgctgaaagaattctacagttccgcagaagaaaagacgactgtcttaaaagaactgtttaatgattttatcaaaaataatgagaattatgatctttctgaaatttatatttctcgtgaagccttaaatacaatcagccaccgctgggtatcggctgcaactctgccggagtttgagaaatctgtatatgaagtgatgaagaaagataaaccctcaggtctttcttttgataaggatgataattcgtataagttcccggattttattgccttatcgtacatcaagggaagctttgagaagctgtctggtgagaagttgtggaaggacgggtactttcgcgacgaaacgcgcaatggtgacaagggattccttattggaaatgagtcactgtggacacaatttatcaaaatttttgagtttgagttcaattcgttgtttgaagcaaaaaacaccgaacgttctgtaggatactatcactttaagaaggattttgagaagattatcaccaatgatttttcggtgaacccggaagacaaagtaattattcgcgaatttgctgacaacgtcttagccatctaccagatggctaaatattttgctatcgagaagaagcgtaaatggatggaccaatatgataccggggacttctataaccatcccgactttggctacaaaactaaattctacgataatgcgtatgaaaaaatcgtcaaggcacgtatgctgttacagtcctatttaactaaaaagccatttagtactgataaatggaagctgaacttcgaatgtggatacttacttaatggatggtcgtcttcatttaatacttacggctcccttctgttccgtacgggaaatgaatactatcttggtgtcgtcaatggctccgcccttcgcacggagaagattaaacgccttactggcaatattacggaagctaactcctgccataagatggtctacgatttccaaaagccagataataaaaacgttccgcgtatctttatccgttcaaaaggggataaattcgcacctgctgtatcagagctgaacttgcccgtcgactcaatcttagagatctacgacaagggactgtttaagacggagaacaagaactcaccgttcttcaaaccgtcgttgaagaagctgattgactactttaagctggggttcagccgtcacgcgtcatataaacactatcagttcaagtggaaagattcatccgaatacaaaaatatttccgagttctacaatgatacgattcgctcgtgttatcagattaagtgggaagaattaaactttgaggaagtgaagaagctgacgaactctaaagacctgtttcttttccagatctacaataaagatttttcagagaaaagcacgggaaataagaatcttcattccatttacttcgacgggctgtttcttgataacaacattaacgcgcaggacggtgttattctgaaattgtctggaggtggagagatctttttccgtccgaagaccgacgtcaaaaagctggggtcgcgcactgatactaaagggaaactggtgatcaaaaacaaacgttactcgcaggataaaatttttttgcactttcccattgaattaaattactcaaacacgcaagagtccaactttaacaagttggtccgcaactttttggctgataacccggatatcaatatcattggagtggaccgtggcgagaagcatttaatttactatgccgggatcgaccagaaaggcaatactctgaaggacaaagatgacaaagacgtccttggtagtttgaacgagatcaatggcgttaattattacaagttgttggaagaacgtgccaaggcccgtgaaaaagcccgccaagattggcaaaatatccaaggtatcaaggacttgaagatgggatacatctctttagttgtacgcaagcttgccgatttaatcattgagtataacgctatccttgttttagaagatttgaatatgcgcttcaagcaaattcatggtggaatcgaaaaaagcgtctatcagcaattggaaaaagccctgatcgaaaaacttaactttttagttaacaagggggagaaggatcccgaacgcgccggtcatttgttgcgtgcgtaccagttaacagcccccttcagcacttttaaagacatgggcaaacaaacaggcgttcttttttatacacaggcatcttatacatcgaaaacgtgcccgcagtgtggctttcgccccaatatcaagctgcattttgataatttagaaaatgccaaaaaaatgcttgaaaaaattaacatcgtctacaaggataatcacttcgaaattggctataaggtttctgatttcacgaaaaccgaaaagacaagtcgcggaaacattctgtatggtgatcgccaaggcaaagacactttcgtaatttcatctaaagccgccatccgctataagtggttcgcacgtaatatcaagaacaacgagttgaaccgcggagagagcctgaaggaacacactgagaagggagtaaccattcaatatgatattacagaatgtctgaagattttatacgaaaaaaacggtatcgatcactccggcgatattaccaagcaaagtatccgcagcgagctgcccgctaaattctataaggacttacttttctatttgtaccttcttacgaacactcgctcgtccatttccggcaccgagattgattatatcaattgcccagattgcggttttcattccgaaaagggatttaacggttgtatttttaatggcgacgcaaacggagcgtacaatatcgctcgcaagggaatgctgatccttaaaaagatcaatcagtataaggaccaacatcatactatggataagatgggctggggcgatttattcattggtattgaagaatgggacaaatacacacaagtcgtctcacgctcataa

SEQ ID NO: 842 - DNA, 3822 bp, Prevotella sp.
  source 1..3822: mol_type = genomic DNA
atgaaagaaattaaagaactaacaggcttgtattctttaactaagactattggggtagaattaaagccagtgggtaagacgcaagagctcattgaagctaaaaagcttattgagcaggatgatcagcgtgccgaagattacaaaatagtaaaggatattattgatcgttatcataaggattttatcgataagtgtcttaactgtgttaaaatcaaaaaagatgatttggagaaatatgtgtcattggcagaaaactctaatagagatgctgaggattttgacaaaatcaagaccaaaatgcgtaatcagataactgaagctttcagaaagaattctttatttactaatttattcaagaaaaatcttattaaggagtatcttcctgcttttgtaagtgaggaagagaagagtgtggtgaacaaatttagcaaatttaccacttactttgatgcgtttaatgacaatcgtaaaaatttatattcaggcgatgccaaatccggtacgatagcttatcgacttattcatgagaatttgccgatgtttcttgataatatagcatcctttaatgcaatttctgggataggagtaaatgagtacttttctagtatagagacagaatttactgatactcttgaaggaaagcgtctgactgagttttttcagattgacttttttaataatacattgactcagaaaaagataggcaactataactatattgtaggggcagtcaataaagctgtaaatctttataagcaacagcacaaaacagttcgtgttccattgctcaaaccattatataaaatgatcttgagtgatagagttactccgtcatggttacctgaacgttttgaaagtgatgaagagatgctgactgccatcaaagctgcttacgaatctttgagagaagttttagtaggtgataatgatgaaagtcttcgcaacttattgctcaatatagagcattatgatcttgaacatatttacattgcaaatgattccggattgacttccatttcacagaaaatatttggatgttatgatacttatactttggcaatcaaagaccaactacaaagggattatcctgcaacaaagaagcaaagagaagctcctgatttgtatgatgaacgtatagataaattgtataaaaaggtgggtagtttttctattgcttatcttaatcggttagtcgatgcgaaagggcattttactattaatgaatattataagcagttgggagcttattgtcgtgaagaaggaaaagaaaaagatgatttctttaagcgtattgatggtgcttattgtgctatatcacatcttttctttggggaacatggcgaaatagcccagtcagactcagatgttgagcttatccaaaagttgctcgaagcctataaggggttacaacgctttatcaagcctttattaggtcatggtgatgaagctgataaagacaatgagtttgatgcaaaacttcgtaaagtatgggatgaactcgacatcattacaccgctttatgataaagtacgcaattggctctctcgtaagatatataaccctgagaaaataaagctatgttttgagaataatggcaagttgttatctggatgggttgacagcagaactaaatccgataatggtactcaatatggagggtatatctttagaaagaagaatgaaattggtgaatacgatttctatttgggtatttctgctgatacaaaactgtttcgtcgtgatgctgccatcagttatgatgatggcatgtacgagagattagattattatcagctgaaatcaaaaactttactcggaaatagttatgttggagattatggactggattcgatgaatttgctttctgcatttaaaaatgctgcagttaagttccaatttgaaaaggaagtggttcctaaagataaagagaatgtgccaaaatatctcaagcgcctaaaactggattatgcaggattttatcaaattttgatgaatgatgataaggttgttgatgcttacaagattatgaagcagcatattcttgcgacattgacttcttcgattcgtgtacctgcggcaatagagttagctactcaaaaagaattgggtattgacgaattgattgatgaaataatgaatttaccgtccaagtcattcggctatttccctattgtcactgcagcaatagaagaagctaacaagagagagaataaacctttgtttctttttaagatgagtaacaaggatctttcttatgcagcaacagcttctaaagggttaagaaaaggtcgaggaacagagaatcttcattcaatgtatctcaaagctcttctggggatgacacagagtgtttttgatatcggaagtggaatggtattctttcgtcaccaaactaaaggtttggcagaaacaacggcaagacataaagctaatgagtttgttgctaataagaacaagcttaatgacaagaaaaagagtatttttggctatgagatagtgaagaataaacgttttacggtagataagtacctttttaagttgtctatgaatttgaattattcgcaaccaaataacaataaaattgatgtaaattctaaagttcgtgaaataattagtaatggaggtataaagaatattattggcatagatcgtggtgaacgtaatttactttatctgtctttaatagatctgaagggaaatattgtcatgcagaagtctctcaatattctcaaggatgatcataatgcaaaggaaactgattataaaggtttgctgacagaacgagaaggagaaaataaagaagctcgccgcaattggaagaagatagcgaatatcaaagatttaaaacgaggttatttaagtcaggtagtacatatcattagtaaaatgatggtagaatacaatgcaattgttgtacttgaagatttaaatccaggttttatcagaggcagacaaaaaatcgagcgtaacgtatatgaacaattcgaaagaatgctaattgacaagttgaatttttatgttgacaagcataaaggtgccaatgaaacgggaggtttgttgcatgcacttcagcttacttctgaatttaaaaatttcaagaaaagtgagcatcagaatgggtgtcttttctatattcctgcatggaatactagcaaaatagatcctgcaacaggttttgtcaatctctttaatacgaaatatacgaatgcagttgaggcgcaggagttctttagtaaatttgacgagattcgttacaacgaggagaaagattggtttgagtttgaatttgattacgataaattcactcagaaggcgcatggtacacgtactaagtggacgctctgtacttatggtatgcgtttgcgttcatttaaaaattctgcaaaacaatataattgggattcagaggtagtagcgcttaccgaagaattcaaaagaatacttggagaagcaggtattgatattcatgagaatctaaaagatgcaatctgtaatttggaaggtaaaagccagaagtatctcgaacctttgatgcagtttatgaaattgctgctacaattgcgtaatagtaaggctggtactgacgaagattatatcctttctccagttgctgatgagaatggaatattctacgatagccgttcttgtggtgatcaacttccggagaatgcggatgctaatggtgcttacaacatcgctcgcaagggactgatgctgattgagcaaatcaagaatgcagaggatttgaataacgtcaagtttgatatatccaataaggcttggctcaattttgcacaacaaaagccatataagaatggatga

SEQ ID NO: 843 - DNA, 3822 bp, synthetic construct
  misc_feature 1..3822: note = Description of Artificial Sequence: Synthetic polynucleotide
  source 1..3822: mol_type = other DNA
atgaaagagattaaagaattgactgggttgtatagtcttacgaaaaccatcggagttgagttgaaacccgtgggaaagactcaagagttaatcgaggctaagaaattgattgagcaagatgatcagcgtgccgaggactataaaattgtgaaggatattattgaccgctatcacaaggattttattgataagtgtttgaattgtgtgaaaatcaaaaaggatgacttggagaagtatgtatctttagcggagaacagtaaccgtgatgcggaagactttgataagatcaagacaaagatgcgcaaccagatcaccgaggcattccgcaaaaattctttattcacaaatcttttcaaaaaaaacctgatcaaagaatatcttcctgcattcgtctctgaagaggagaaatcagtggttaataagttttcgaagtttacgacctatttcgacgcttttaatgataatcgcaaaaacttgtactccggtgatgctaaatctggaacgattgcctaccgtttaatccatgaaaatcttccaatgtttttagacaatatcgcctcgttcaatgccatttcgggtatcggagttaacgaatacttctcttctattgaaaccgaatttacagacacattagaaggaaagcgtttgactgaattttttcaaatcgatttctttaacaacactcttacacaaaaaaaaatcggcaactataattacatcgttggtgctgtgaacaaggcagtcaatctgtacaagcagcagcataagacggtccgtgtaccattacttaagcccctgtataagatgatcttatccgaccgcgtaacgccgtcatggttgccagagcgtttcgaatcggacgaagagatgcttacggctatcaaagcggcctatgaatccttacgtgaggtgttggtaggcgataacgacgagtccctgcgcaaccttttactgaatatcgaacattatgatttggaacatatctatatcgctaacgattctggccttacatctattagccagaagatcttcgggtgttatgacacttatactttagcgattaaagatcaattgcaacgtgactatcccgcaacaaagaagcagcgtgaagcgccagacttgtatgacgaacgcattgacaagttgtataaaaaagtcgggtctttttctattgcgtatttgaaccgcttggtagacgcgaaagggcactttaccattaacgagtattacaagcaattaggcgcatattgccgtgaagaagggaaggaaaaagatgacttctttaaacgcattgacggcgcctattgcgcgatcagccacctgtttttcggagagcatggggaaatcgcgcaaagcgattctgatgtcgaattaattcagaagctgctggaggcatataaggggcttcaacgctttatcaagccgttgctgggacatggggatgaagccgataaagacaacgaatttgacgcaaagttgcgtaaagtgtgggacgagttagacatcattacgcccttgtacgacaaggtccgcaattggctgagccgcaagatctataatcctgaaaagattaagttgtgtttcgaaaataatggcaagcttctgtcgggctgggttgactcacgcacaaaatcggacaacggaacacagtatggcggttatattttccgtaaaaaaaacgaaatcggggagtatgatttttatcttgggatctccgccgacaccaaattattccgtcgcgatgcggctatcagttatgacgatggaatgtatgaacgcctggactactatcagttaaaatccaaaactcttttaggtaatagttatgtcggcgattatggtctggatagcatgaaccttttaagtgcatttaagaatgcagccgttaagtttcagtttgagaaagaagttgtaccaaaagacaaagaaaatgttcccaagtatctgaaacgcttaaagttggactatgccggtttttaccaaattttaatgaatgacgataaagtggtagacgcgtataagattatgaaacaacacatccttgccacccttacctcttcaatccgcgtgcccgcggcaattgaattagctacgcagaaagagttggggattgacgaactgattgatgagatcatgaacttgccatcaaaatcattcgggtactttccgattgtgactgcagcgattgaggaagctaacaaacgtgaaaataaaccgcttttcctgtttaagatgagcaataaagatctgagctacgctgccacagcctcgaaggggctgcgtaaggggcgtggtacagaaaatttgcattctatgtatcttaaagccctgttggggatgacacagtctgtgttcgacattgggagtggaatggtattttttcgccaccagactaaaggtcttgctgagaccacggcgcgccataaagcaaacgagttcgtagcgaacaaaaataagcttaatgataaaaagaaatccatctttggatatgaaattgttaaaaacaaacgtttcacagtcgataagtacctttttaaactttcgatgaatttgaactactcacaaccaaataataataaaattgatgttaactcaaaggtgcgtgagatcattagtaatggcggtatcaagaacatcatcggcatcgaccgtggggagcgcaacttgttatatttaagtttaattgatttgaaaggaaacattgttatgcagaagtccttgaatatcctgaaggatgaccataacgccaaagagacggactataaaggcttattaacagagcgtgagggtgaaaacaaggaggcacgtcgcaattggaagaaaatcgcgaacattaaagacttaaagcgcggctacctgtctcaagtggttcatatcatctccaagatgatggtagagtacaacgcaatcgtggttttggaagacttgaacccagggtttattcgcgggcgtcagaaaattgagcgtaatgtttatgaacagttcgaacgcatgttaatcgacaaacttaacttctacgtggacaaacataagggagcgaacgaaacgggcggcttattgcacgcattgcagttaacatcggaattcaaaaatttcaaaaaatctgaacaccaaaatggatgcttattctacatccccgcgtggaatacgagcaagatcgacccggcgactgggttcgtgaacttgtttaatactaaatatacaaatgccgtagaagcccaagaatttttctccaaattcgacgaaatccgctataatgaggaaaaagactggttcgagttcgaattcgattacgataagtttacccagaaggcacacggaacccgcactaaatggacgctgtgcacctatggcatgcgtctgcgttctttcaaaaatagtgcaaagcaatataactgggacagcgaggtggtggcattgaccgaggaatttaagcgcattttgggagaagccggcattgatatccacgaaaacttaaaggatgctatttgtaatctggaaggaaaaagtcaaaaatacctggagcctcttatgcagttcatgaagctgttgctgcaacttcgtaacagtaaagctggaacagacgaagattatatcttatcaccagtcgctgatgaaaatggcattttttacgattctcgtagctgcggggaccaattgccggaaaatgcagacgctaatggagcctacaatatcgcccgtaaagggttaatgttgatcgaacaaatcaagaatgctgaagaccttaacaacgtaaagtttgatattagcaacaaagcgtggctgaattttgcccagcaaaagccctataagaatgggtga

SEQ ID NO: 844 - DNA, 3822 bp, synthetic construct
  misc_feature 1..3822: note = Description of Artificial Sequence: Synthetic polynucleotide
  source 1..3822: mol_type = other DNA
atgaaggagattaaggaactgacgggactgtattcattgaccaaaactattggagtggaacttaagccagttggcaagacgcaagaattgattgaggccaaaaagctgatcgagcaggacgatcagcgcgctgaagattacaagatcgttaaagacatcattgatcgctatcataaagacttcattgataaatgtctgaactgcgttaaaatcaagaaagatgatttggagaagtatgtaagcttggctgaaaactctaaccgcgacgccgaggatttcgacaaaatcaaaacgaaaatgcgcaaccagatcacggaggcatttcgtaagaatagtctttttacaaacttattcaagaagaatcttattaaagaatatcttccagcgtttgtttcggaagaagagaagtcagttgtcaataaattctcgaaattcacgacgtatttcgacgcctttaatgataaccgcaagaacctgtactccggcgatgcaaaatcgggtacaatcgcgtaccgtttaattcacgaaaatttaccaatgtttttggacaacattgcgagtttcaacgccatctcaggtatcggagtaaatgagtactttagctctattgagacggaatttactgacaccttggagggtaaacgtctgacggaattttttcaaattgacttttttaacaatactttaacacaaaaaaagattggcaactataattacatcgtgggcgccgtaaataaagctgttaatttgtataagcagcaacacaagacagtgcgcgtgcccttgctgaagccattatataaaatgatccttagtgatcgtgtgactccgtcttggttacctgaacgtttcgaaagcgacgaggagatgttaacggcaatcaaggcagcttacgaatcactgcgtgaagttcttgtaggtgacaacgatgaatcgttgcgcaatttgcttctgaacatcgagcattacgacctggaacacatttacatcgcaaatgatagcggcttgacatcaattagtcaaaaaatttttggctgctacgacacatatactttggccatcaaggatcaacttcagcgcgactaccccgctacgaagaagcaacgtgaagctcctgatttgtacgatgagcgcattgataagttatacaagaaggtaggctcatttagcatcgcgtatcttaatcgtttagtcgatgccaaaggccacttcacgattaatgagtattataaacaattaggcgcatactgccgcgaggaaggaaaggaaaaggacgacttttttaagcgtattgacggtgcgtactgcgcaatcagccacttattttttggcgagcatggagaaattgctcaaagcgacagtgacgtcgaacttattcaaaaattacttgaagcgtataaaggtctgcagcgctttattaaaccgttactgggccatggtgatgaggcggataaagataacgagtttgatgccaagcttcgtaaagtgtgggatgagctggacattattaccccattatacgacaaggttcgcaattggttgtcacgtaaaatctacaaccctgaaaagatcaagttatgcttcgaaaataatgggaaactgttatccgggtgggttgattcgcgtacgaagagcgataacggcacccaatacggaggatacatcttccgcaaaaaaaacgagattggtgagtatgacttctatttaggtatcagcgccgacactaagctgttccgtcgcgacgcggcaatctcctatgatgatggtatgtacgagcgtcttgattattatcaattgaagagtaaaacattgcttgggaactcgtatgtgggtgattacggcttagacagtatgaatctgttaagtgcattcaagaacgcagccgttaagtttcagtttgaaaaggaggtggtaccaaaagataaggagaacgttcctaagtacttgaaacgtttgaaattagattacgcaggtttctaccagatccttatgaatgatgacaaagttgtcgacgcatacaaaattatgaagcagcatattctggctacactgacatcctcaattcgcgtaccggctgctattgagttagcgacgcaaaaagagttgggtatcgacgaattgatcgatgagattatgaacttgccttcaaagtctttcggatacttcccgattgtcactgcagctatcgaggaagccaacaagcgtgagaataaacctttgtttttgttcaagatgtccaataaagacttaagttatgccgcgactgcatcaaagggtcttcgcaaggggcgtggcacagagaaccttcactctatgtatctgaaagctctgttggggatgacacagtcggttttcgacatcggttcgggcatggtattctttcgccaccaaacaaaaggactggcagagacaactgcgcgccataaggcaaatgagttcgtcgcgaacaaaaataagttaaatgataagaagaagtctatcttcgggtacgaaattgttaaaaacaaacgttttactgtagacaagtacttgtttaaacttagcatgaacttaaactatagccaaccaaataataacaagattgatgttaacagtaaagttcgtgaaatcatctccaacgggggaattaagaacattattgggatcgaccgtggtgagcgcaacttattgtacctttcattgatcgatttaaaaggcaacatcgtgatgcaaaaatcactgaacatcttgaaggatgatcacaacgcaaaggagacagactacaaaggtttgctgactgagcgtgaaggcgagaacaaagaagcccgtcgtaattggaaaaagattgcaaatatcaaagacttgaagcgcggatacttgtcacaagtcgtacatatcatctctaagatgatggtcgaatataacgccattgtagtactggaggacttgaatccaggattcattcgtgggcgccaaaaaatcgagcgcaatgtctacgaacagtttgaacgcatgttaatcgataaactgaacttttacgtcgacaagcacaagggtgccaatgagacaggaggattgttacacgcacttcaattgacgagtgagtttaaaaactttaaaaaatctgagcaccaaaacggctgtcttttctatatccctgcgtggaatacgtctaagatcgaccccgccaccggatttgtaaatctgttcaacactaagtatacgaacgctgtggaggcacaagagttcttctcaaagtttgatgaaattcgttacaatgaggaaaaagattggtttgagtttgaatttgattatgacaaatttacacagaaggcccatgggacccgcaccaagtggaccctttgtacttacggaatgcgtctgcgtagcttcaaaaactccgcaaaacagtataactgggactccgaagtagttgcattaacagaggaatttaagcgtattttgggtgaagcaggaattgacatccatgagaatttaaaagatgccatctgtaatttagaaggtaagtcacaaaagtatttggaaccattgatgcagtttatgaaactgctgcttcaacttcgtaatagtaaggcgggcaccgatgaggactatattctgtctccagtcgcggatgagaatgggatcttttacgactcacgttcgtgtggcgatcaactgccagaaaatgccgacgctaacggggcctataatattgctcgcaagggtttgatgttgatcgaacaaattaaaaatgcagaggatcttaacaacgttaagtttgacatttctaacaaagcatggcttaattttgctcaacagaaaccgtacaaaaacgggtga

SEQ ID NO: 845 - DNA, 3822 bp, synthetic construct
  misc_feature 1..3822: note = Description of Artificial Sequence: Synthetic polynucleotide
  source 1..3822: mol_type = other DNA
atgaaagaaattaaagaacttactggactttattcattgacaaagactattggtgtcgagttaaaacctgtaggcaagacgcaggagttgatcgaggcgaagaaattgatcgagcaggatgatcagcgcgccgaggactacaagatcgtaaaagacatcatcgatcgttaccataaagactttattgacaagtgcttaaactgcgttaagatcaagaaagatgacctggaaaagtatgtttccttggcagaaaactctaaccgcgatgccgaggactttgataaaatcaaaaccaaaatgcgtaatcagattaccgaggcatttcgcaaaaatagcctgttcacaaaccttttcaagaaaaacttgatcaaagaatatttacctgccttcgtatcggaggaggagaaatcggtcgtgaacaaattctcaaaattcactacgtattttgacgctttcaacgacaaccgtaagaacctttactcaggcgacgcgaaaagtggtactattgcttatcgcttgattcatgaaaaccttcctatgttccttgataatattgcttccttcaacgcaattagcggaattggggtgaacgaatacttttcgtctattgaaactgagtttacagacaccttggaggggaaacgtttgaccgaattttttcaaatcgatttctttaacaataccttaacccagaaaaaaattggtaactacaattacatcgtcggggctgttaacaaggccgttaatttatacaagcagcagcacaaaactgtccgcgtccccctgttgaagcccttatacaagatgatcctttcagatcgcgtaactccctcctggttgccagaacgtttcgaatcagacgaagagatgttgaccgcaattaaggccgcgtatgaaagtctgcgtgaggtgttggtcggtgacaacgacgagagtctgcgcaatcttttgcttaacattgagcattacgatcttgagcacatttacatcgccaatgattctggacttacttcaatttctcagaaaatcttcggctgttacgatacgtacactttagcgatcaaagaccaattacagcgtgactatcccgcaactaagaaacagcgtgaagccccggacttgtatgatgaacgcatcgacaagttatacaaaaaggtgggatcattctctattgcctatttgaatcgtttggttgatgccaagggtcattttacgattaatgagtactacaaacagttaggcgcttattgtcgtgaggagggtaaggagaaagacgacttcttcaagcgtatcgacggtgcatattgcgctatttctcatctgtttttcggggaacacggggaaatcgcacaatccgacagtgatgtggagttaattcagaagcttcttgaggcgtataaaggacttcagcgctttatcaaacctctgcttgggcacggcgatgaggccgacaaggacaacgagttcgatgctaagcttcgcaaggtgtgggatgagcttgacattattacgccgttatatgacaaagtacgcaattggttatcacgcaagatttacaaccctgaaaaaatcaagttgtgttttgaaaacaacggaaaacttttatctggctgggtcgatagtcgcactaagagcgataacggtacacaatacggcggctatatttttcgcaagaagaatgagatcggagagtacgatttctaccttggaatcagtgccgacacaaaattgtttcgtcgtgacgccgcaatcagttacgatgacggaatgtacgagcgcctggactactaccaacttaagtcgaaaacgttattgggcaatagttatgtgggggactacggccttgatagcatgaaccttctgtccgcgttcaagaacgcggcggtgaaattccaatttgaaaaagaagtagtgccgaaggataaggaaaacgttccgaagtatttaaaacgtcttaaactggattatgccggattctatcaaatcttgatgaacgacgataaggtagtagacgcttacaagatcatgaagcaacacatcttggctacacttacgtcctcaattcgtgtaccagcggcaatcgagttggcgacccagaaagagctgggtattgacgagctgatcgacgaaatcatgaaccttccatccaagtctttcggttattttcccattgtgacggccgctattgaggaagcaaataaacgtgaaaataagcctttgttccttttcaagatgtccaacaaggatctttcctatgcggcaacagcttcgaaaggcctgcgcaaaggacgtggcaccgaaaatcttcattcgatgtatctgaaggcattattagggatgacccagtctgtgtttgacattgggtcaggcatggttttttttcgccaccagacaaaggggcttgccgagaccactgcacgccacaaggccaacgagtttgtagcgaataaaaacaagttaaatgataaaaagaagtctatctttgggtacgaaatcgtaaaaaacaagcgtttcactgttgacaagtatctgttcaaactgtcaatgaacttaaattattcgcagccaaataacaacaagatcgatgtaaactccaaggtgcgcgagattatttccaatggtggaattaaaaacattattggaattgaccgtggagaacgcaaccttctttacttatcgttgatcgatttgaagggcaatattgtcatgcagaagtcactgaatatccttaaagatgaccacaacgccaaagaaactgactacaagggtcttttaaccgagcgcgagggtgaaaacaaagaagcgcgtcgtaattggaaaaaaattgctaatattaaagatttaaaacgcgggtacttaagtcaggtcgttcatatcatctccaagatgatggttgaatataatgcaattgtcgtcttagaggatctgaatccaggtttcatccgcgggcgccagaagatcgagcgcaatgtctatgagcagtttgaacgcatgttaattgataagttgaacttctatgttgacaaacacaagggagcaaatgaaactggcgggttgttgcatgcattacagttaacctctgaatttaagaacttcaaaaaatctgagcatcaaaatggctgtctgttttatatcccggcttggaatacgtcgaaaattgaccccgcaacgggattcgttaacctgtttaacacaaaatacacgaacgccgtggaagcccaagagttctttagcaagtttgatgagattcgttacaatgaggaaaaagattggttcgagtttgagttcgactacgataagttcacgcaaaaggcccacggcacgcgcaccaaatggacattatgcacatacggtatgcgcctgcgcagcttcaaaaacagtgcgaagcagtataactgggattccgaggtcgtcgcattgacagaagaatttaagcgtatcttgggcgaggcaggtattgatattcatgaaaacttaaaagatgctatctgtaaccttgaggggaaaagccagaaatacctggaaccccttatgcagtttatgaagctgcttttgcaattacgtaatagtaaggcaggtactgatgaggactacattctgtcgccggttgctgacgaaaatgggatcttctatgattcccgttcttgcggggaccagttaccagaaaacgctgatgccaacggtgcttacaacattgctcgcaaaggcttgatgcttattgaacagatcaaaaacgccgaggatttgaataatgtaaaattcgatatttctaataaggcatggctgaactttgcccagcaaaagccctacaagaatgggtga

SEQ ID NO: 846 - DNA, 3903 bp, Acinetobacter indicus
  source 1..3903: mol_type = genomic DNA
atgaattttcaaccattttttcaaaaatttgtacacttatatccaatttccaaaaccttacgttttgaactaatcccacagggtgcaacacaaaaatttatttcagaaaagcaagtattgttacaagatgaaatcagagcacgtaaatatcctgaaatgaaacaggcgattgacggctaccataaagactttatccaacgtgcgctgagcaatattgacagtcaagtatttgaacaggcattaaatacatttgaagatttatttctacgctctcaagcagaaagagcgacagatgcctataaaaaagattttgaaacagcacaaacgaaactaagagaattaatcgttcatagttttgaaaagggtgaatttaaacaagaatataaatccctttttgataagaatttaatcaccaatttattaaagccttgggtggaacaacagaatcaaataggtgacagcaactatacgtatcatgaagattttaataaatttactacctacttcttaggtttccatgaaaatcgtaaaaacatttatagcaaggatccccacaagactgcccttgcctaccgtttaattcatgaaaatttacctaaatttttagaaaacaataaaattctactcaaaatccaaaatgatcatcctagtttgtgggaacaactgcaaacactcaatcaaacgatgcctcagttgtttgatggttgggatttctcgcaactgatgcaggtgtcattctttagcaatacattgacccaaacagggatcgaccaatacaacaccatcattggcggaatttctgaaggtgaaaaccgtcaaaaaattcaaggtatcaatgaactgattaatttatataaccaaaaacaagataagaaaaatcgtgtcgcaaaacttaaacaactgtataaacaaattttaagcgaccgcagcaccctgtcttttttacctgaaaaatttgttgatgataccgagctatatcatgcgatcaatatgttctatttagaacatttacatcatcaaagcatgatcaatggtcactcttacacgttgctagaacgtgtgcaattactcatcaatgaattagccaactatgatttgagtaaagtttatttagcaccgaatcaactgagtactgtttcccatcaaatgtttggagattttggctatatcggtcgggcattaaattattattatatgcaagtcatacaacctgattatgaacagttattagcaagtgctaaaacaaccaaaaaaattgaagcgactgaaaaactaaaaaccatatttctggatacccctcaaagccttgtggtgattcaagctgccattgatgaatatattcaattacaaccaagcacaaagccacatacacaattgaccgactttatcatctctctactcaaacaatatgaaactgtagcggatgatcaaagcattaaagtcatcaatgtttttagtgatattgaaggtaaatatagctgtatcaaaggtttagtgaatacaaaatctgagtcaaaacgcgaggtattacaagatgaaaaactagcgactgatattaaagcttttatggatgccgtcaacaatgtcataaaattacttaaacctttttcactaaatgaaaagttggttgcaagtgtagaaaaggatgcacgtttttatagtgactttgaagaaatttatcagtcattattaatttttgtgccactttataacaaagtccgaaattacattactcaaaaaccgtatagcactgaaaagtttaaacttaattttaacaaaccgaccttactgagtggttgggatgccaataaagaagccgataatttaagtattttacttagaaaaaatggcaattattatttagcgattatggatactgccaaaggtgcaaataaagcctttgagcctaagacactgaaccagctcaaagtcgatgatacaactgattgctatgaaaaaatggtctataagcttttgtcaggaccaagtaaaatgttccctaaagcttttaaagctaaaaataatgaaggtaactattatccaactccagagttacttacttcttataacaataacgagcatttaaaaaatgataaaaatttcacattagcatcattacatgcctatattgattggtgtaaagagtatataaatcgcaatccatcttggcatcaatttaattttaaattttcacccactcaatctttccaagatataagtcaattttattcggaagtttctagtcagagttataaagttcatttccaaacgattccaagtgactatattgatcaattggtggctgaaggcaaactgtatctgttccaaatttataataaagacttttcaccaaatgctaaaggtaaagaaaatttacataccttgtattttaaagccttatttagcgatgagaatttaaaacagcctgtatttaaactcagtggcgaagcagaaatgttctatcgccctgcttcgctgcaattggcaaacaccaccatccataaggcaggtgaaccaatggcggccaaaaacccattgacgccaaatgccactcgtactttggcttatgacattattaaagatcggcgttttaccactgacaaatatttgctgcatgtacccattagtttaaattttcacgcacaagaatcaatgagtattaaaaagcataatgacttagtccgtcagatgattaagcataatcatcaagatctgcatgtaattgggattgatcgtggtgaaaagcatttactctatgtcagtgtgatcgacttaaaaggcaatattgtctaccaagaaagccttaacagcattaaatcggaagcgcagaattttgaaacgccttatcatcaattgttgcagcaccgtgaagaaggtcgagcgcaagcccgtacagcatggggcaaaattgagaatattaaagaactcaaagatggttatttaagtcaggtggtgcatcgtattcagcaattgattttaaaatacaatgcgattgtgatgttagaagacctcaattttggctttaaacgtggtcgttttaaaattgaaaaacaaatttatcaaaagtttgaaaaagccctgattcataaactcaattatgtggtcgataaatctacccaagctgatgaacttggtggtgtgcgtaaagcctatcaattgactgccccttttgaatcctttgaaaaattaggtaaacaatcaggcgtgttattttatgtccctgcttggaacaccagtaaaattgaccctgtgacaggctttgttgatctacttaaacccaaatatgaaaacttagacaaagctcaagccttttttaatgcctttgacagcattcactataatgctcaaaaaaactattttgaatttaaggtcaatttaaagcagtttgcagggctcaaagctcaagcggctcaagcagaatggacgatttgctcttatggtgatgaacgccatgtgtatcaaaagaaaaatgcacagcagggtgaaacagtcattgtaaatgtgactgaagaattaaaagtcctgtttgcaaagaacaacattgaagttgcacaaagtgttgaacttaaagagacgatttgtacccaaacacaggtcgacttctttaaacgcttgatgtggctgttacaagtattgttggcactgcgttatagcagcagtaaagataaactcgattatattttgtctcctgttgccaatgcacaaggtgagttttttgattcacgccatgcatcggtacaattaccacaagactccgatgcaaacggtgcgtaccatattgccttaaaaggtttatgggtgattgaacaacttaaagctgctgataatttggataaggtcaaacttgccattagcaatgatgattggcttcactttgcacaacaaaaaccatatcttgcttaa

SEQ ID NO: 847 - DNA, 3903 bp, synthetic construct
  misc_feature 1..3903: note = Description of Artificial Sequence: Synthetic polynucleotide
  source 1..3903: mol_type = other DNA
atgaacttccaaccattttttcagaagttcgttcatttatatccgatctctaagacgctgcgttttgaacttatcccccagggggcaacacagaaatttattagtgagaaacaagtgttgttgcaggacgaaattcgcgcgcgtaaatatccggagatgaaacaagctattgatgggtaccataaggattttatccagcgcgcgctttcaaatatcgattctcaggttttcgaacaagcccttaacacgtttgaggatctgttcttgcgttctcaggctgaacgcgctactgacgcatacaaaaaggactttgagaccgcccagacaaaattacgtgaattgatcgtacatagctttgaaaaaggtgaatttaagcaggaatacaagtcattgtttgataaaaacctgatcacgaatttgcttaagccctgggtggagcaacagaatcagatcggagatagtaattacacgtatcacgaagatttcaataaattcacgacttattttcttggcttccatgagaaccgcaagaacatttactcaaaggatcctcacaaaacagctttagcataccgtcttattcatgaaaacttaccaaagtttcttgaaaataacaaaattttgctgaaaattcagaacgaccacccttcgctgtgggagcagttgcaaactctgaaccaaaccatgccgcaactgttcgatggttgggacttttcacaactgatgcaagtgtcattttttagcaatacccttacccaaaccggtatcgatcagtacaataccattattggcggtatcagtgagggtgaaaatcgccaaaaaatccaggggatcaacgagcttatcaacctgtataatcaaaagcaagacaagaaaaatcgtgttgctaagttgaagcagctttacaagcagattctttcagatcgctcgactttatcgtttttgccggagaaatttgtcgatgacaccgagttgtaccatgcgatcaatatgttttaccttgagcatttacatcaccagtcaatgattaacgggcatagctataccctgttagagcgcgttcagctgttaatcaatgagttggccaactacgatttatctaaagtttatcttgcacctaaccagctgtctactgtctcacatcaaatgttcggtgattttggttacatcgggcgcgcgcttaattattactatatgcaagttatccagcccgattacgaacagctgcttgcctccgcgaaaacgactaagaagatcgaggcgacggaaaagttaaagacgatcttcctggatacgcctcagagccttgtcgtaattcaagctgctattgacgaatatattcaattacagcctagcactaaacctcatacccaattgactgatttcatcattagtcttttgaaacagtacgagactgtcgcggacgatcagagtattaaagtcatcaacgtcttctcggacatcgaggggaagtattcgtgtattaaaggcttagttaatactaagagtgagtcgaagcgcgaggtcctgcaggacgagaaactggcaacggatattaaagctttcatggatgcggtcaataatgtcatcaaattgctgaagccattcagcttaaacgagaagttagttgcatccgtagagaaggatgcacgtttctactccgacttcgaagaaatctaccagtcacttctgatctttgtccccttgtacaataaggtacgcaattacattacccaaaaaccgtactctacagagaagttcaaacttaattttaataagcccactttattatcggggtgggatgcaaacaaggaagctgacaatttaagcatcttattgcgtaaaaacgggaactattatttggccatcatggatactgcgaaaggggccaacaaggcgtttgagccaaagacacttaatcaactgaaggtagatgacacgaccgattgctatgaaaaaatggtatataagctgttatcaggaccatctaagatgttcccgaaagctttcaaggctaaaaataacgaaggtaattactaccctacccccgagcttcttacatcatataataataatgagcatctgaagaatgacaaaaacttcacactggcatcattgcatgcatatattgactggtgcaaggagtacatcaatcgtaacccctcttggcatcaatttaacttcaaattttcccctacacaatccttccaggatatttcacaattttatagcgaagtgtcatctcagagttataaggtacactttcaaacaatcccctcggattatattgaccagctggtagcagagggtaaactttacttgtttcagatctataacaaggacttttcgcccaacgccaaagggaaagaaaatctgcataccctgtattttaaagcactttttagtgacgaaaacctgaagcagcctgtatttaagttgagcggtgaggcggaaatgttttaccgtccagcttctttacaattggcaaacaccacgattcataaagcgggtgaaccaatggccgcgaagaaccccctgacgccgaatgcgacccgtaccttggcgtacgatattattaaggaccgccgttttactacagataaatacttattacacgtccccatctctttaaatttccacgctcaggaatcgatgtcgattaagaaacacaacgatctggtacgtcagatgattaaacataatcatcaggatcttcatgttattgggattgatcgtggcgagaagcatctgttgtatgtcagtgtgattgatttaaaagggaatattgtttaccaagaatcccttaattcgatcaaatccgaggcgcagaattttgagaccccttaccaccaattgttacaacatcgtgaggaggggcgtgcccaagctcgcacagcctggggtaagattgagaacattaaagagttaaaagatggctacctttcacaagttgttcatcgtattcagcagcttattctgaagtacaacgcgatcgtgatgctggaggaccttaatttcggttttaaacgcggtcgtttcaaaattgaaaagcagatttaccaaaaattcgaaaaagccttaattcacaagctgaactatgttgtcgacaagtccactcaagcagatgaattagggggcgtccgtaaggcctatcaattgacggcgcccttcgagtcttttgaaaagttgggaaagcaaagtggtgtcctgttctatgtaccggcgtggaacacttcgaaaatcgatcccgtgacgggtttcgtagatttgcttaagccgaaatacgagaatttagataaagcacaggccttcttcaacgcttttgatagtatccattataatgcacaaaaaaattattttgaattcaaagtaaacttgaagcaattcgccgggttgaaagcgcaggccgcgcaggcggaatggacgatctgttcttacggtgacgagcgtcacgtgtatcagaagaagaacgcccagcagggcgaaacagtcatcgtgaacgttacggaagagttgaaagtccttttcgctaaaaacaacattgaagtggctcaaagtgttgaactgaaagaaactatctgtacccagactcaggtagacttctttaaacgcctgatgtggttgttacaggtacttctggcgcttcgttatagctctagcaaggataaacttgattacatcttgagtcctgtggctaacgcacaaggcgagttcttcgactcccgtcacgcttcagtgcagcttccccaggacagtgatgctaatggtgcgtaccacattgcgctgaaagggctgtgggtcatcgaacaacttaaagccgctgataacttagataaagtgaaactggcaattagtaatgatgactggttgcattttgctcaacaaaagccataccttgcctaa

SEQ ID NO: 848 - DNA, 3903 bp, synthetic construct
  misc_feature 1..3903: note = Description of Artificial Sequence: Synthetic polynucleotide
  source 1..3903: mol_type = other DNA
atgaactttcaaccgttcttccagaaattcgtgcatttatatcccatctctaaaactttgcgttttgagttaattccgcaaggagccacacaaaagtttatcagcgaaaagcaagtgctgttacaagatgaaattcgcgctcgcaaatatccggagatgaagcaggcaattgacgggtatcataaagatttcatccagcgtgcccttagtaacatcgattcacaggtgttcgagcaggctttaaatacgtttgaggatctttttttgcgttcgcaagcggaacgcgcgactgacgcgtacaagaaagatttcgagaccgcacaaactaaacttcgcgaacttatcgtccactctttcgagaaaggcgagtttaaacaggagtataaaagcttgttcgacaaaaaccttattactaacttgttaaaaccatgggtcgaacagcagaaccaaattggggatagtaattatacttaccacgaagatttcaacaagttcacaacgtatttccttggctttcatgagaaccgtaagaacatctatagcaaggacccacacaagacagcgcttgcttatcgtcttatccatgagaacctgccaaagttcttagagaacaataagatcctgctgaagatccagaacgaccatccctctctttgggaacagttacagactcttaatcagacgatgccacaattgttcgacggttgggacttcagccaactgatgcaggttagcttcttttcaaatactcttacccagactggaattgatcagtataatactattattggtggaattagtgaaggcgaaaatcgccaaaagattcagggcatcaatgagctgatcaatctgtacaatcagaaacaggacaagaagaaccgcgttgctaaattgaagcaattatataaacagatcctttcagatcgttcaaccctgagttttcttccagaaaaattcgtagatgacaccgaattgtaccacgctattaacatgttctatttggagcacttgcaccatcaatcgatgattaatgggcactcatacacccttttagagcgtgtccaacttctgattaatgagcttgcaaactatgatttgtctaaggtatatctggctccgaatcaactgagcacggtttcccaccagatgtttggggatttcggatacatcggacgcgctttaaactactactacatgcaggtgattcaacccgactacgagcaactgttggcatctgctaagaccactaagaagatcgaagcaaccgagaaattgaagacaatcttcctggacaccccgcagtctctggttgtaatccaggccgctatcgatgagtacatccagctgcagccatccaccaagccacacacgcaattaacggacttcattatctccttgttgaagcaatatgaaaccgtggcagatgaccaatctattaaggtgatcaatgtcttctctgacattgaggggaagtacagttgcattaaagggttggttaacacgaagtcggaatccaaacgtgaggtcttgcaggacgagaagctggcgacggacattaaagcatttatggacgccgtaaataatgtgatcaaacttttaaagcctttttcgttaaatgaaaaactggtcgcttctgtagagaaggatgcccgcttttattcggactttgaggaaatctatcaatctttgctgatctttgttcccttatacaataaggtacgcaattatattacccagaagccctactccactgagaagttcaaacttaacttcaataagccaactttattaagtggttgggatgcgaataaagaggcggataacttatcgatcttactgcgtaaaaatgggaactattacttggccatcatggatacagcgaaaggagccaacaaggctttcgaacccaaaacacttaaccaactgaaggtcgacgatactacagattgttacgaaaaaatggtctataaattattgtctggcccatccaagatgttcccaaaagcatttaaggcgaaaaacaatgagggaaactattatccgaccccggagcttttgacttcctataacaacaatgaacatctgaaaaacgacaaaaattttacgctggcgtccttgcatgcgtatattgattggtgcaaagagtatatcaatcgcaatccgagttggcatcaattcaattttaagttctcgcccactcaaagcttccaagacatttcgcaattctactccgaggtttctagccagtcgtataaagtccacttccaaaccatcccgtccgactacattgatcaattggtcgccgaagggaaactttaccttttccaaatctataataaggatttctctccaaacgctaaagggaaagaaaatctgcacaccttatactttaaagcgctgttctcagacgagaacttgaagcaacccgtatttaagctgagtggagaggcggagatgttttaccgtccggctagcctgcagttggcaaacacgacgattcataaggcaggggaaccaatggcggccaagaacccgctgacaccgaacgcaactcgtacgctggcatatgatatcatcaaggatcgtcgcttcacgacagacaagtacctgcttcatgtacctatctcgcttaatttccacgcgcaggaatccatgtctatcaaaaagcacaacgatttggtccgccagatgattaaacataatcatcaggatttgcatgtaatcggtattgatcgtggtgagaagcatttgttatatgtctctgttattgacttgaagggaaacattgtttatcaagagtcgttaaattctatcaaaagcgaggcgcaaaactttgaaactccctaccaccaacttcttcagcaccgcgaggaaggacgtgctcaagcccgtacggcatggggcaaaatcgagaatatcaaagagttgaaggacggttatctgtctcaggtcgtacatcgtattcaacagcttattctgaagtataacgcaattgtaatgttagaggaccttaatttcgggttcaaacgcggtcgcttcaaaatcgaaaaacaaatttaccaaaagttcgagaaggccttgattcataagctgaattacgtcgtagacaagagtactcaagcagatgagttggggggggttcgtaaggcttatcaactgacagccccttttgagtccttcgaaaaattagggaagcaatcgggtgttctgttttacgttccggcctggaacacctctaaaatcgaccctgtgactggtttcgtagatttgttaaagccaaaatatgaaaatctggacaaagcacaggcgttcttcaacgccttcgacagcattcattataatgcacaaaagaactatttcgaatttaaagtaaatttaaaacagttcgccggtctgaaggcacaggctgcacaagcagaatggactatttgctcatatggggacgagcgtcatgtctaccaaaagaaaaacgcccagcagggtgaaaccgtgatcgtgaacgtcactgaggagttaaaggtgctttttgctaagaacaacattgaggtcgctcagagtgttgagttgaaggagaccatctgcacacaaactcaggttgatttctttaagcgtcttatgtggttgcttcaagtcttacttgctcttcgttactcgtcctcgaaggacaaacttgactacatcttgtcgcctgtagcaaatgcccagggcgagttctttgattctcgtcacgcgtcggttcagttgccgcaagactcagatgcgaacggcgcgtatcacattgcgctgaaaggattgtgggtaatcgaacaactgaaagcggcagataaccttgacaaggtcaagcttgcaattagtaacgatgattggctgcatttcgctcaacagaagccgtatttagcgtaa

SEQ ID NO: 849 - DNA, 3903 bp, synthetic construct
  misc_feature 1..3903: note = Description of Artificial Sequence: Synthetic polynucleotide
  source 1..3903: mol_type = other DNA
atgaactttcagccgttctttcagaagtttgtccatctgtatcctatcagcaaaacacttcgtttcgaattgatcccacaaggggcaacgcaaaagtttatctccgagaaacaggtacttctgcaggacgagatccgtgctcgtaaatatcctgaaatgaagcaagctattgatggataccacaaagacttcatccaacgtgccttgtcaaatattgatagccaagtctttgaacaagctcttaatacatttgaagatttattccttcgcagtcaagccgaacgtgctactgatgcgtacaagaaggatttcgagaccgctcagacaaaattgcgtgaacttatcgtgcatagttttgaaaaaggcgaatttaagcaagagtataaatccctttttgataaaaatttaattaccaaccttttgaaaccatgggttgagcagcaaaaccaaattggcgactctaactacacctaccacgaggacttcaataagtttacgacttatttcttggggtttcatgagaatcgcaagaatatctattctaaagacccacacaagactgcacttgcgtatcgcctgattcatgagaacttgcctaaattcctggagaataataaaatccttctgaaaattcaaaatgaccatccaagcttatgggagcaactgcagacattaaaccagactatgccccaactttttgacggttgggatttcagtcaattgatgcaagtatccttttttagtaacactttgacacagactggcatcgaccaatacaatacaattatcggcggcattagtgaaggtgagaaccgtcaaaagattcagggtatcaatgaacttatcaacttgtataaccaaaaacaagataagaaaaaccgtgtcgccaaattaaagcaattgtataaacaaattctgtccgatcgttccacgctgagctttcttcctgagaagtttgtagacgatacggaattgtaccatgctattaatatgttttacctggaacatttacaccatcaatcgatgatcaatgggcacagctacaccctgttagaacgcgtacagttgcttattaacgagcttgctaattacgacttatcaaaggtatatctggcccccaaccaactgtcaactgtgtcccaccaaatgtttggtgatttcggctatatcggacgcgccttgaattattattacatgcaagttattcaaccagattatgaacaactgctggcgtcggctaaaacaacgaaaaagatcgaggccacggagaagcttaagacaatttttttagacactccacaatcattggtcgtgattcaggctgcgatcgatgagtatattcagcttcaaccgtctaccaaaccgcatacgcaacttacggattttattatctcattgttaaaacaatatgagacagtcgccgacgatcagtctattaaagtcatcaacgtcttttccgatattgagggtaaatactcgtgtattaagggattagtcaacacaaagtcggagagcaaacgcgaggtattgcaagacgagaaattggccactgacattaaagcctttatggatgctgtaaataatgttatcaagctgctgaaaccattcagtcttaatgagaagttggttgcttctgtcgaaaaggatgctcgcttctactcggacttcgaagagatctatcagtcattactgatcttcgttcctctttataataaggtgcgtaattacatcactcaaaaaccatacagtactgagaagtttaagttgaattttaataaacctactttattatcgggctgggatgcaaataaggaagccgacaacttgagcatcttgcttcgcaagaacgggaattattatttagcaatcatggacaccgcaaagggggccaacaaggcattcgaacccaaaactttgaaccagctgaaagttgatgacacaacagactgctatgagaagatggtatacaagcttctgagcgggccctcgaaaatgtttcccaaagccttcaaagccaaaaacaatgaaggtaactattatccgactcctgagcttttgacaagttacaacaacaacgaacatttaaaaaatgacaaaaatttcacgttggcgtctctgcatgcatatatcgattggtgtaaggagtatatcaaccgtaacccatcgtggcaccaatttaatttcaagttctcacctacacagtcattccaagatattagtcagttttatagcgaggtctcaagtcaatcgtacaaagttcattttcaaacaatccctagtgattatatcgatcagctggtcgcagagggcaaattatatcttttccagatctataacaaggactttagccctaatgcgaagggaaaagagaatctgcacactttatactttaaagctttgttttccgatgagaatttaaaacagcctgtattcaagttgagtggggaagccgaaatgttttatcgtcctgcatcgttacaattggcaaataccacaattcataaggctggcgaaccaatggctgccaaaaaccccctgactccgaatgccactcgtacgcttgcatatgatattattaaggaccgtcgttttacaaccgataaatacctgcttcacgtaccgatttctttaaacttccatgcacaggagtcgatgtcgattaaaaagcataacgacctggtacgccagatgatcaaacacaatcatcaggacttacacgtaattgggatcgaccgcggagaaaagcacttgttgtatgtctctgtaattgacttgaaagggaatatcgtctatcaagagtccttaaactcgattaagtcagaagcgcaaaactttgaaaccccctatcaccaacttttgcaacatcgtgaagaggggcgcgctcaggcccgcactgcctggggaaagatcgaaaacatcaaggaattaaaagacggctacctgtcccaagtggtgcatcgtatccaacaacttatcttaaagtacaacgctattgtcatgttggaagatttaaactttggcttcaagcgtggacgctttaaaatcgagaaacagatttatcagaagtttgaaaaggctctgattcataaattgaattatgtggtagacaagtcaactcaagccgatgaacttggcggtgtgcgtaaggcataccaattaaccgcaccgtttgagagtttcgaaaagttgggaaaacaatccggcgtcctgttttacgtccctgcgtggaacaccagcaaaatcgatcctgtcaccgggttcgtggaccttttgaagcccaaatacgaaaacttggacaaggcacaggccttcttcaatgctttcgattcaatccattacaacgctcaaaagaactattttgagttcaaggtcaatctgaaacaattcgcagggcttaaagcacaagcagctcaagctgaatggactatctgctcgtatggggacgaacgtcacgtttatcagaagaagaatgcacaacagggggaaacggtcatcgtcaatgttaccgaagaattgaaagttttatttgctaaaaacaacattgaagttgcacaatcagtagagcttaaagaaaccatctgcacgcaaacgcaggtcgactttttcaagcgtcttatgtggcttctgcaggtactgttagcactgcgttactcttctagcaaggataaactggattatatcctttcccccgtagccaatgcacaaggagagttcttcgactcacgccacgcatcggtacaattaccgcaagacagtgacgcaaatggtgcgtaccatatcgccctgaagggtttatgggtcatcgagcaactgaaagctgccgacaatttagacaaggtcaaattagcaatttcgaacgacgattggttgcacttcgcacagcagaaaccttatttagcataa

SEQ ID NO: 850 - DNA, 3618 bp, Pseudobutyrivibrio xylanivorans
  source 1..3618: mol_type = genomic DNA
atgtattatcagggtttaacaaagctatatccaattagtaaaactattagaaacgaattaattcctgtaggaaagactttagaacatattagaatgaataatattcttgaggctgatattcagagaaaatcagattatgaacgtgtaaagaagctaatggatgactatcataagcaattaataaatgagtctttgcaagatgtccatttgtcttatgttgaggaggcagctgatctatatctaaatgcttctaaggataaagatattgtagataagtttagtaagtgtcaggataaattgcgaaaagagatagttaatctcttgaagagtcatgaaaactttccaaagataggaaacaaggaaataataaaattactacagagtctttctgatactgaaaaagactataacgcgttggattcatttagcaagttttatacatattttactagctacaatgaggttagaaagaatttgtattccgatgaagaaaaatcatccacagcggcatatcgattgataaatgaaaatttgcctaaatttctagataatattaaggcttattctattgctaaatctgcaggtgtgcgagctaaagaactgaccgaagaagaacaggattgtctttttatgactgaaacttttgaaaggacacttactcaggatggaattgataattataacgaattgattggaaagcttaattttgcgattaatctatataatcagcaaaataataaactcaagggatttcgtaaagtacctaagatgaaagaactgtataaacagattttgtcggaaagagaggcatcatttgttgatgaatttgttgatgatgaagcattgctaactaacgtagagtctttttctgcacatattaaagagtttttggaatcggattctctttcaagatttgcggaagtccttgaagaatctggtggggaaatggtttatataaaaaatgatacttcaaagacaacattttcaaatatagtatttggctcttggaacgtaattgatgaaagattggcagaggaatatgattctgctaattctaagaaaaagaaggacgaaaaatattacgataagcgtcataaagaactgaaaaagaacaagagctattctgtggagaagatagtttcattatcaacggaaacagaggatgtgattggaaaatatatagagaagcttcaagcggacattattgctataaaagagacgcgagaagtttttgagaaagttgttcttaaggagcatgataagaataaatctcttagaaagaatactaaagccatcgaggcaattaaatcatttttagatacaataaaagattttgagcgagatataaaacttattagcggtagcgagcatgagatggagaagaatcttgccgtttatgcagagcaagagaatattttatcttcaattagaaatgtggattctctatacaatatgtcaagaaattatctcacccaaaagcctttttcaacagaaaagtttaagttgaattttaatagggcaacattattaaatgggtgggataaaaataaagaaactgataatctaggtattcttttggtaaaagaaggaaaatattacttaggaattatgaatactaaagctaataaaagttttgtaaatccacctaagccgaagacagacaatgtatatcataaagtgaattataagctattaccaggaccaaataagatgttgcctaaggtcttttttgcaaagtcaaatcttgaatattacaaaccatcagaagacttgctagcaaaatatcaagcgggtacacataagaaaggagagaatttttctttagaagattgccattcattgatttctttctttaaagactctctagaaaagcatccagactggtcagaatttggatttaagttttctgatacaaaaaaatatgatgatttgagtggattttatagagaggtagagaagcaaggatataagataacatatacggatattgatgtagagtatattgatagtttggttgaaaaagatgagttgtatcttttccaaatctacaataaggatttctcgccatatagtaaggggaattataatctccacacgctatatctgacgatgttatttgatgagcgtaatttacgtaatgtggtttataaattaaatggtgaggctgaagttttttatagacctgcttcaattggaaaggatgaactaattattcataaatctggagaggaaataaagaataagaatccaaagagggctattgataaaccaacaagtacattcgaatatgatatcgtcaaagatcgaagatatactaaggataaatttatgttacatattccagtaactatgaattttggcgtggatgaaactagaagattcaatgaggtcgttaatgatgctataaggggagatgataaagttagagtcattggaattgatagaggcgagagaaatttattatatgtagtagttgttgattctgatggaactattttggagcagatttctcttaattctattattaataatgagtattcgatagaaacagattatcacaaattgctggatgagaaagaaggggatagagacagagcacgcaaaaattggactactatagaaaatattaaagaacttaaagaggggtatctaagtcaggtagttaatgttatagcaaaattggttttgaaatatgatgctattatctgccttgaagatttgaattttggatttaagcgtggacgtcaaaaagttgaaaaacaggtatatcagaaattcgaaaaaatgcttattgataaattgaattatttagttattgataagagtagaagccaagagaatcctgaagaagttggacatgtcttgaatgcgttacagttaacttcaaaatttactagttttaaggaattaggtaaacagacaggtattatttattacgttcctgcgtatttaactagtaaaattgatccgacaacaggtttcgcaaatctcttttacgtaaaatatgagagtgttgaaaagtccaaagatttctttaatagatttgatagcatttgttttaacaaagtagcaggttattttgagtttagctttgattataaaaactttactgatagagcctgtggtatgagaagtaaatggaaagtatgtaccaatggtgaacgaatcattaaatatagaaatgaagaaaagaacagttcttttgatgataaggtgatagttttaacggaagaatttaagaagttgttcaatgagtatggcattgcttttaatgattgtatggacctgactgatgcaataaatgctattgatgatgctagtttcttcagaaagttgactaaattgttccaacagacattgcagatgcgaaatagttcggctgatggttccagagattatattatctcgccagttgagaatgataacggggagttttttaactccgaaaaatgcgataaatcaaaaccaaaagatgctgatgctaatggagcatttaatattgccagaaagggattatgggtgttagaacaactttataattcatcatcaggagaaaagcttaatttagcaatgacaaatgctgaatggttagagtatgcacagcaacatacgatttaa

SEQ ID NO: 851 - DNA, 3618 bp, synthetic construct
  misc_feature 1..3618: note = Description of Artificial Sequence: Synthetic polynucleotide
  source 1..3618: mol_type = other DNA
atgtattaccaggggttgaccaaattgtacccgatcagcaagacaatccgtaacgagcttatccctgttggaaaaacgttggagcacattcgcatgaataatattttagaggccgacatccagcgcaaatcggattatgagcgtgtcaagaagttgatggatgactatcacaaacagttgatcaacgagtcgttgcaagatgttcacttgagttacgtcgaagaagccgccgatctgtacttaaatgcttccaaagacaaagatattgtggataagttttcgaagtgtcaagacaagcttcgcaaggagattgtgaaccttttaaagagccacgagaactttccgaagatcggaaataaggagatcattaagttacttcagtcattgagtgacactgaaaaagactacaacgctcttgactctttctcaaagttttacacgtattttacttcatataatgaggtgcgtaaaaacttgtattccgacgaggaaaaaagctcaacagccgcctaccgtcttattaacgagaacttacctaagttcctggataatattaaggcttacagcattgccaagagcgcaggggtgcgtgcgaaagaactgacggaggaggagcaagattgtttgtttatgacagagacattcgagcgcacattaactcaggacgggattgataattacaacgaactgattggcaagcttaattttgcgatcaacttatataaccaacaaaataacaaactgaagggcttccgtaaggtaccgaaaatgaaggaactttataaacaaattctgagtgaacgtgaagcaagttttgtagacgaatttgtagatgacgaggctttactgaccaacgttgaaagcttcagcgcacacattaaagaatttttagagagtgattcgttatctcgctttgccgaggtattagaagagtcggggggagaaatggtatacattaagaacgacacctcgaagacaaccttcagtaacatcgttttcggatcatggaatgtcatcgacgaacgcttggccgaggaatacgacagcgcaaactccaaaaagaagaaagatgaaaagtattatgataaacgccacaaagagctgaaaaagaataaatcctattcagtggaaaagatcgtcagcttaagtacagagactgaggacgtgattggtaaatatattgaaaaacttcaggctgatatcatcgcaatcaaggaaacacgtgaagtctttgaaaaggtagttctgaaggaacacgataaaaacaagagcctgcgtaagaataccaaagccattgaggcaatcaaatcttttttagatactatcaaagattttgagcgtgatatcaaactgatttcagggtctgagcacgaaatggagaaaaaccttgctgtgtacgcagagcaagaaaacatcctgtcgtcgattcgtaatgtagattctttgtacaatatgtcccgtaactacttaacgcagaagccttttagtaccgaaaaatttaaacttaacttcaatcgcgccaccttattaaatggttgggacaaaaataaagaaactgataacttaggcatcttgctggtgaaggaaggaaaatattatcttgggatcatgaatacaaaggcaaacaagtcattcgtgaatcccccgaagccgaaaacagacaatgtataccacaaagtaaactacaaacttcttccaggcccaaataaaatgttaccgaaggtcttcttcgctaagtcaaacctggaatattataaaccttcggaagatttattggcaaaatatcaggccgggacgcacaaaaaaggggagaatttctcccttgaagactgtcactctcttatctcgtttttcaaagactcgttggagaagcaccctgactggagtgaattcgggtttaagtttagcgatactaagaagtatgatgacctgagcggtttctaccgcgaggtggagaagcaaggatataaaattacctataccgacattgatgttgagtacatcgatagtcttgtcgaaaaggatgagctttacttgtttcaaatctacaataaagacttttcaccttatagtaaaggtaactacaatctgcacacactgtacctgacgatgctgttcgatgagcgtaatttgcgtaacgtcgtctataaattgaatggtgaggcggaggttttctaccgcccagcgtctatcggcaaggacgaattgattatccacaagagtggagaggaaattaagaacaagaatcctaaacgtgctattgacaagccaacctccacgtttgagtacgatattgttaaagaccgccgctacactaaggataagtttatgctgcacattccagtgacaatgaactttggcgttgatgagacccgccgttttaacgaggtcgtcaacgatgcaattcgtggggacgacaaggtacgtgtcattggtattgaccgtggcgagcgcaatctgctgtacgtcgtcgtggttgactctgacgggacgatccttgagcaaattagtctgaattccattattaataacgaatacagcattgaaaccgactaccataagcttttggacgaaaaggaaggcgaccgtgaccgcgctcgtaaaaattggactacaattgagaatatcaaagaattaaaagaaggctaccttagccaagttgtaaacgtgatcgcaaaattggtattgaaatacgatgccatcatctgtttggaagatttaaactttgggtttaaacgtggccgccaaaaagtggagaagcaggtatatcaaaagtttgaaaagatgttaattgataaacttaattatttggtaattgacaaatcccgtagccaagaaaatccggaagaggtgggtcatgtcctgaacgcccttcaattaactagtaagttcactagctttaaggagttgggcaaacaaactggcattatctattacgtcccggcctatcttaccagcaagattgaccctaccactggcttcgccaatttattttacgtcaagtatgaaagtgtagagaagtctaaagacttttttaatcgttttgattcgatctgtttcaacaaggtagccggatactttgagtttagtttcgactacaaaaatttcacagaccgcgcctgcggcatgcgtagcaagtggaaagtctgtacgaatggagaacgcatcattaaatatcgcaacgaggaaaagaattcgtcattcgatgataaggtcatcgtgctgaccgaagaatttaagaagctttttaacgaatatggtatcgcgttcaatgactgtatggatttaacagacgctatcaatgcgattgatgatgctagctttttccgcaagctgacaaagttatttcaacaaacattgcaaatgcgcaactcctccgctgacggctctcgcgattatattatttctcccgtagaaaacgataatggagagttctttaatagcgagaagtgtgacaaatcgaaaccaaaggacgccgatgctaacggtgcgttcaatattgcacgcaagggactttgggtcttagagcagttgtataacagctccagcggtgaaaaacttaatctggccatgaccaatgctgaatggttggagtacgcgcagcagcacaccatctaa

SEQ ID NO: 852 - DNA, 3618 bp, synthetic construct
  misc_feature 1..3618: note = Description of Artificial Sequence: Synthetic polynucleotide
  source 1..3618: mol_type = other DNA
atgtactatcagggactgactaagctttatcccatctcgaaaacgattcgcaatgaattgatcccagtcgggaaaacgttagagcatatccgtatgaataatattcttgaagcagacatccagcgcaagtccgattacgagcgtgtgaaaaaattaatggatgattatcataaacaattaatcaatgagtcgttgcaggatgtgcatttgtcatacgtggaggaagcggctgacctttacttaaatgcttctaaagataaggatatcgttgacaagttcagcaagtgccaagataaattgcgcaaggaaatcgtgaacctgctgaagagccatgagaattttccgaagatcgggaataaagagattattaagcttttgcaaagcctttccgatacggaaaaagattacaatgcgttggactcgttctcgaagttttatacctactttacctcatataatgaagtacgcaaaaatctttattcagatgaagaaaagtctagtacggctgcctatcgtctgatcaatgaaaatcttccaaagtttctggacaatattaaagcttactcaatcgccaagtcggcgggagtgcgcgcgaaggaattgacagaggaggaacaagactgtttgttcatgacggaaacctttgaacgcactcttacgcaagacgggattgacaactacaatgaattgatcggaaagctgaactttgccattaatttgtataatcagcaaaacaacaagcttaaaggtttccgtaaagtccctaagatgaaggagttgtacaaacaaatccttagcgagcgtgaagcatcctttgtggatgaatttgtagatgacgaggccttgttgaccaatgtggaatcgttctcagcacacattaaggagtttttagaatccgactcactgtcccgttttgctgaagttttggaagagagtgggggggaaatggtttatattaagaatgatacctctaagacgactttttcgaatatcgtctttgggtcatggaatgtgatcgacgagcgtttggccgaggagtacgatagtgccaattccaaaaaaaaaaaagacgaaaagtattatgataaacgtcacaaagaacttaagaagaacaaatcctattccgtagagaagattgtgtcactgtctacagaaactgaggatgtaattggaaagtacattgagaagcttcaagccgatatcatcgctatcaaagagacccgtgaagtgtttgaaaaagtcgtcctgaaagaacacgataagaacaaatcactgcgtaagaacacgaaagctatcgaagctattaagtcgttccttgacactatcaaggacttcgaacgtgatatcaaattaatctcgggttcagaacacgaaatggaaaaaaatttagcggtttacgctgaacaggaaaatattttaagcagtattcgtaacgtcgactcattatacaacatgtcgcgcaattaccttactcaaaaaccattttccacggaaaaatttaagttgaatttcaatcgtgccacccttttaaatggttgggacaagaataaggaaacggataaccttggaattttactggttaaggagggaaagtattatttgggcatcatgaacactaaggctaacaaaagcttcgttaacccgcccaagccgaagacagataatgtataccacaaagttaattataaactgttgccaggtccgaataagatgcttcccaaggtgttcttcgccaaaagcaacctggagtactacaagccgtctgaggatcttcttgctaaatatcaggctggcacgcataagaagggcgaaaattttagcttagaagactgccacagcctgatttcattcttcaaggacagtttggaaaagcatcctgattggtcagagtttggatttaaattttcggatacaaaaaaatacgacgacctttcgggtttctaccgtgaggtagaaaaacaaggatataagatcacatataccgatatcgacgtagagtacatcgactccttagtagagaaagacgagctgtatttattccagatttacaataaggacttttcaccatactctaaagggaattataatctgcacaccttgtaccttacaatgttattcgacgaacgtaatctgcgcaacgtggtatacaagctgaatggggaagcggaagtattttatcgccccgcttcaatcggtaaagacgaattaattatccataagtcaggggaggagatcaagaataagaatcctaaacgtgctattgataagcccacatccacgttcgagtatgatattgtaaaggaccgccgctatacaaaggataagtttatgttacatatcccggttaccatgaacttcggtgtggacgagactcgccgtttcaatgaggtcgttaatgacgcaattcgtggtgacgataaagtccgtgtcattggaatcgatcgcggagaacgtaatttattgtacgtggtcgtagtggactccgatggaacaattttggaacagatctctcttaattcgatcatcaataatgaatacagtatcgagacggactaccacaaattacttgatgaaaaggagggtgatcgcgaccgtgctcgcaagaactggacaacgattgagaatatcaaagaactgaaggagggttatctttcgcaggtcgttaatgtgatcgcaaaattggtattaaaatacgatgcaatcatctgcttagaagatttgaatttcggtttcaaacgcggacgccaaaaagtcgagaagcaggtctaccagaagtttgaaaagatgttaatcgacaaattgaattaccttgtaatcgataaatctcgttcacaagaaaatccagaagaagttggacacgttctgaacgcgttacaactgacaagcaaatttacaagctttaaagagcttgggaaacaaactggtatcatctattatgttccagcctatttgacatccaagatcgatccaactactggtttcgcgaacttgttttacgtcaaatatgagtcagtggaaaagtcaaaggattttttcaatcgctttgatagtatttgctttaacaaagtggccggctatttcgaatttagctttgattacaagaacttcactgaccgtgcttgcggtatgcgttcgaagtggaaagtgtgtactaacggcgagcgcatcatcaaatatcgtaacgaagagaagaactcctccttcgacgacaaggtcatcgtccttaccgaagaatttaaaaaattgtttaatgaatatggtattgctttcaatgattgtatggacttgacggatgcaattaacgctatcgacgacgcgagcttcttccgtaaattgaccaaattatttcagcagacgctgcaaatgcgcaacagcagtgctgatgggtcgcgtgattacatcattagtccggtcgagaacgataatggggagtttttcaactctgaaaaatgcgacaagtcaaagcctaaggacgcagatgccaatggagcgtttaacattgcccgtaagggtttgtgggtgctggagcaattatacaacagtagctctggggagaagctgaacctggcaatgactaatgccgagtggttagagtacgcgcaacaacacactatctaa

SEQ ID NO: 853 - DNA, 3618 bp, synthetic construct
  misc_feature 1..3618: note = Description of Artificial Sequence: Synthetic polynucleotide
  source 1..3618: mol_type = other DNA
atgtattaccagggcttaactaagttatatccgatctcaaagaccattcgcaatgagttgattcccgtaggcaagacacttgaacacatccgcatgaataacattcttgaagcagacatccaacgcaaatcggattacgagcgcgtaaaaaagttgatggatgattatcacaaacaattaatcaacgaatctcttcaggacgtacacttaagctacgtggaagaggctgcagatctgtaccttaatgccagtaaggacaaagatattgtagataaattctcgaaatgtcaggacaaacttcgtaaggagatcgtaaatttgcttaagtcacacgaaaacttcccaaaaatcggtaataaagaaatcatcaagctgcttcaatctcttagcgacacagaaaaagattacaatgctttggactcgttttctaagttctacacatatttcacgagttacaatgaagtacgcaaaaatttatacagcgacgaagagaagagcagcaccgcggcatatcgcttgatcaatgagaatctgcccaaatttttagataacatcaaggcttattcgattgctaagtcggcaggggttcgcgcgaaggagcttacagaagaggaacaggattgtctgtttatgacagaaaccttcgagcgtactctgacacaggatgggattgacaactacaacgaattaatcggaaaacttaattttgcgattaacctgtacaatcaacaaaataacaagctgaagggcttccgtaaagtgcccaagatgaaagaactttataaacaaatcttgagtgagcgcgaggcatctttcgtggacgaatttgttgacgatgaggccttgctgaccaatgtggagagcttttctgcccacatcaaggagttcctggaatcagatagtcttagtcgctttgcggaagttcttgaggaaagcgggggtgagatggtatacattaaaaatgatacatctaaaactactttcagcaatatcgtgtttgggtcgtggaacgtcatcgacgagcgcctggcagaagaatacgacagcgctaattcgaaaaaaaaaaaagatgagaaatactatgacaaacgccacaaagagctgaaaaaaaataaaagctatagtgtcgaaaaaattgtctctctgtctaccgaaactgaagatgttattggtaaatatattgaaaaactgcaagctgatatcatcgcaatcaaagaaacccgtgaggtattcgagaaagtcgtactgaaggaacatgacaagaacaagtctcttcgtaagaacaccaaagccattgaagccattaagtcattccttgacactatcaaggattttgaacgtgacattaaactgatcagtgggagcgaacacgagatggagaaaaacttggccgtctatgccgaacaagaaaatattttaagttcaattcgtaacgttgattccctttacaatatgtcacgtaactatttgacacaaaagccgttttcaacagaaaagttcaagttgaactttaaccgcgcaacattacttaatggatgggacaagaacaaagagacggataatcttggcatcctgctggtcaaagaaggcaaatattatttgggtattatgaatactaaggcaaataaatcattcgttaacccccctaagcctaaaaccgacaacgtgtatcataaggtgaattacaagttattacctggccccaacaaaatgctgccgaaagttttcttcgcaaagtctaatttggagtactacaaaccttctgaagatcttctggctaaatatcaggcgggaacccacaaaaaaggtgaaaattttagcttggaagattgccacagtttaatttccttttttaaggattccttagaaaaacacccagattggtccgaattcggcttcaaattttcagatactaagaagtatgacgatctgtcgggcttctaccgcgaggtggaaaaacaagggtacaagattacttatacagatatcgacgtcgagtatattgactctttggttgaaaaggacgaactgtatctttttcagatctacaacaaagactttagtccttacagtaagggcaactacaaccttcatactttatacctgacaatgcttttcgacgaacgcaatcttcgtaacgtggtttataaattgaatggcgaggcagaagtgttttaccgcccggcgtctattggaaaggacgagcttatcatccataagtccggggaagagatcaagaataagaaccctaagcgcgctattgacaaaccgacatccacgtttgaatacgatattgttaaggaccgccgctacactaaagacaaattcatgttgcatattccggtcaccatgaattttggggttgatgaaacacgtcgtttcaatgaagtagtaaacgatgctatccgcggagacgataaggtacgcgtcattggaattgatcgcggagaacgcaatctgttatacgtagttgtcgtagactcagatgggaccattctggagcagattagcttgaacagtattatcaacaacgagtattcaattgagaccgattaccataaactgttagatgaaaaagagggtgatcgtgatcgtgcgcgcaagaattggacgactatcgaaaatatcaaggaattaaaagagggatacctgtctcaggtagtaaatgtgattgctaagttggtgctgaaatacgacgctatcatctgcttggaggatcttaacttcggtttcaagcgtgggcgccaaaaggtcgagaaacaggtctaccaaaagtttgaaaaaatgttaattgacaaattgaactacttagtgattgataaatcacgctcacaggaaaacccagaggaagttggacacgttttaaacgccttacaactgacgagtaagtttacctcttttaaagaattaggtaaacagacgggcatcatttattatgtccctgcctacttaaccagtaagatcgatccgacgacaggatttgctaatcttttctatgtcaaatacgaaagcgtagaaaaaagtaaagatttctttaaccgcttcgactccatttgcttcaataaagtagccggctacttcgaattttcgttcgactacaagaactttaccgaccgcgcgtgcggtatgcgtagcaaatggaaggtttgcacaaatggtgagcgtatcatcaagtatcgcaacgaagaaaaaaacagcagctttgacgataaggtgatcgtgttgacggaggaatttaagaagctgttcaacgaatatggtattgctttcaatgattgtatggacttgacggatgccattaacgcaattgacgatgcaagcttttttcgtaagttgactaaattgtttcaacaaactctgcaaatgcgtaattcttcggcagacggttctcgcgattacattatttcgccggtagagaatgataacggcgaattcttcaattcggaaaagtgcgacaagagcaaacctaaggatgcggatgcgaacggggccttcaacatcgcccgtaaagggttgtgggtgctggagcaattatacaatagttcatcaggagagaaacttaatctggcgatgactaatgctgagtggctggagtacgcccaacaacatacaatctaa

SEQ ID NO: 854 - DNA, 3921 bp, Prevotella sp.
  source 1..3921: mol_type = genomic DNA
atggctaagaattttgaagattttaaaagactttatcctctttcaaagactttgcgctttgaagcgaagcctattggcgccactttggataatatagttaagagtggtttgttggaagaagatgaacacagagctgcaagctatgtgaaggtgaagaaattgattgatgaataccacaaggtatttattgatagagtgttggataatggatgtttgcctttggatgataaaggtgataataattcattggcagaatattatgagagctatgtatctaaagcgcaagatgaggatgcaataaagaagtttaaggaaattcagcaaaatcttctctctattatagctaaaaagctaacagacgataaggcttatgctaatttgtttggtaataaacttatagagtcatataaggacaaagctgataagacaaagctaattgattcagatttgattcaattcatcaatactgcggaatcaactcaacttgtttcaatgtcacaagatgaggccaaagaactcgtaaaagaattctggggctttactacatattttgaaggtttcttcaaaaatcgtaaaaatatgtatactccagaagaaaagtctactggtattgcttatcgtctaatcaatgaaaaccttccaaagttcattgataatatggaggctttcaagaaagctatcgctagaccagagatacaggctaacatggaagagttatactctaatttttctgaatacttaaatgtagaaagtattcaggagatgttcctgcttgactattacaatatgcttcttactcaaaagcagattgatgtctataatgctataattggaggaaaaaccgatgatgagcacgatgttaagattaaaggtatcaacgagtatatcaatctctataatcagcagcataaagatgacaagttaccaaaacttaaggcattgtttaagcagattcttagtgatagaaatgcaatatcttggttgccagaagagttcaatagtgatcaggaagtcttgaatgcaatcaaggattgctatgagcgattggctgaaaatgttttgggtgataaggttctcaagtctttgcttggttctttggcagattattctcttgatgggatatttatccgtaatgacttgcagttgactgatatttctcagaaaatgtttggaaattggggtgtgattcagaatgctatcatgcagaatataaagcatgttgctcctgcaagaaagcataaggagtctgaggaagattacgaaaaaagaattgctggtatattcaaaaaggcagatagttttagtatcagttatataaatgattgcttgaacgaagcagatcctaataatgcctactttgtagagaactatttcgcaacatttggagcggtaaatactccaacaatgcagcgtgagaatctgtttgcgcttgttcaaaatgcgtatacagaagttgctgcattacttcattctgattatcctacggtaaagcatctggcacaagacaaggctaatgtttctaaaatcaaagcactgttggatgcaataaagtctttgcagcatttcgtgaagcctctgttgggcaagggtgatgaaagtgataaagatgaacgtttctatggtgaactagcttcgttgtgggcagaacttgatacagtgacaccgctgtataatatgattcgtaattatatgactcgtaaaccatattctcaaaagaaaatcaaacttaactttgagaatcctcaattgcttggtggttgggatgctaataaggagaaagactatgctaccattatcttacgtcgtaatgggttgtattatcttgctattatggacaaagactcaaggaagttattgggtaaggcaatgccgtcagatggggagtgctatgagaaaatggtatataagttcttcaaagacgtgacaacgatgataccaaagtgtagtacacaattaaaagatgtacaagcttattttaaggttaatacagatgattacgtcttaaatagcaaggcgtttaacaggccattgacgataacaaaggaagtctttgatttgaacaatgtattgtatggtaagtataagaaattccaaaagggatacttgactgctactggtgataatgtaggttatactcatgctgtaaacgtatggataaaattctgtatggattttttggacagctatgatagcacttgcatatatgatttctcttctttgaaaccggagtcatatttgtcactcgactctttctatcaggatgttaatttgttgttgtataaattgtcgtttacagatgtatctgcatcatttattgatcagcttgttgaggagggaaagatgtatctgttccaaatctacaataaggatttctctgagtatagcaagggcactccaaatatgcatactctttattggaaagcattgtttgatgaacgtaatctggcagatgtagtttacaagcttaacggacaggcagagatgttctatcgtaagaaaagtatagaaaatactcatccaactcatcctgctaatcatcctattcttaataagaataaggataacaagaaaaaagaaagcttgtttgaatatgatcttataaaagatcgtcgctacactgttgataaatttatgttccatgtgccaatcacaatgaactttaaaagttctggttctgagaacatcaatcaagatgtgaaggcgtatttgcgtcacgcagatgatatgcatattattggtattgatcgtggcgaacgtcatttgctgtatttggttgtaattgatttgcaaggtaatatcaaggagcagttctcgcttaatgaaattgtgaatgattataatggtaatacctatcataccaattatcacgatttgttggatgttcgtgaagacgaacgactcaaagctcgtcaaagttggcagaccatcgaaaatatcaaagagctgaaagagggctatttgtctcaggttatccacaagattacacagctcatggttagatatcatgccattgttgttttggaagatctgagcaagggatttatgcgtagtcgtcaaaaggtagaaaagcaagtatatcagaagtttgaaaaaatgttgatagataagcttaactatttggtagacaaaaaaactgatgtttctactcctggaggcttgctgaatgcataccaacttacctgtaagtctgatagttctcaaaagttaggaaaacagagcggattcctgttctatatccctgcatggaatacatctaagatagacccagttacaggatttgtcaacttgttggatactcattctttaaattctaaagagaaaatcaaagcattcttctctaagtttgatgctatccgttataataaggataagaaatggtttgagtttaatctcgactatgacaagtttggtaaaaaagcggaagatacaaggactaagtggactttatgcaccagaggaatgcgtattgatactttcagaaataaagaaaagaactcgcagtgggataatcaggaagttgacttgacaacagagatgaaatctttattggagcattattatatcgacattcatggtaatctcaaggatgctatcagtacgcaaacagacaaagcgttctttactggcttgctgcacatattgaagttgaccttgcagatgcgtaatagtattactggaaccgaaacagattacttagtgtctcctgttgccgatgagaatggaatattctacgatagccgttcttgtggtgatcagcttcctgagaatgcggatgctaatggtgcttacaacatcgctcgcaagggactgatgttggttgagcagataaaagatgctgaggatttggataatgtgaagtttgatatatccaataaggcttggctcaattttgcacaacaaaagccatataagaatggatga

SEQ ID NO: 855 - DNA, 3921 bp, synthetic construct
  misc_feature 1..3921: note = Description of Artificial Sequence: Synthetic polynucleotide
  source 1..3921: mol_type = other DNA
atggcaaagaactttgaagactttaaacgcttataccccttatcgaagacacttcgctttgaagcaaagccgatcggggccacgctggataatatcgtgaaatcggggctgttagaggaagacgaacaccgcgccgcctcctacgtcaaggtcaaaaaacttatcgatgagtaccataaggtctttattgatcgtgttttggacaacggttgtttaccgctggatgataaaggtgacaataattctcttgccgaatactacgaatcgtatgtatcaaaagcccaagacgaggatgcaattaagaaattcaaagaaattcagcaaaatttgctgagtattatcgcaaagaaacttacagacgataaagcctatgccaacttattcggaaataaacttatcgaaagttacaaagacaaagcggacaaaacgaagcttattgatagcgacttgattcagtttattaatacggctgagtctacccaattagtttccatgtcacaagacgaagctaaggagttggtaaaagaattttggggctttactacctatttcgaaggcttcttcaagaaccgtaagaatatgtataccccagaagaaaagagtacagggatcgcttaccgcttaatcaacgaaaacttaccaaaattcattgacaacatggaggcgttcaaaaaagcgatcgcccgtcccgagatccaagcaaacatggaagaactttactctaacttctctgagtacctgaacgtagagtctattcaagagatgttcctgcttgactactacaacatgctgttaactcaaaagcagattgatgtgtacaatgccatcattgggggcaagacagacgacgaacatgacgtcaagatcaaggggattaatgaatatatcaacttgtataaccagcagcataaagatgacaaattaccaaagctgaaagctcttttcaaacagatcctgtctgaccgtaatgccatctcctggttgcctgaggagttcaattctgaccaggaggtgcttaacgcgattaaagactgttacgagcgtctggcggaaaacgttttgggtgataaggtccttaaaagccttctgggctcattagcagattattcgttggatgggatcttcatccgtaatgaccttcagcttacggatatttcgcagaagatgtttgggaattggggggttattcagaacgcaattatgcaaaacatcaaacacgttgctccggcacgcaagcataaggagtcagaggaggactatgaaaagcgtatcgcaggaatttttaaaaaagctgactcgttttccatctcatatatcaacgactgtcttaatgaagctgacccgaataatgcatattttgttgaaaactactttgccactttcggtgccgtaaatacgccaacaatgcagcgtgaaaatttgtttgcacttgtccaaaatgcgtataccgaagtcgcagcacttctgcattctgattatccgactgttaaacatctggctcaggacaaagctaacgtctcgaagatcaaggcattattggacgcaattaaatccttacagcacttcgtcaagccgttgctggggaagggggatgagtcagacaaggatgaacgcttttacggtgaacttgcctccttgtgggccgagctggataccgtcacccctctgtataatatgattcgtaactacatgacgcgtaagccctacagtcagaagaagattaagttgaactttgagaatccgcaattattgggaggctgggatgccaacaaggagaaggattatgctaccatcattctgcgtcgtaacgggctttactacttagcgatcatggacaaggacagccgtaaattattaggtaaggccatgccttctgacggcgaatgctacgaaaaaatggtctacaaattttttaaggatgttactaccatgattccgaagtgttccacgcaacttaaagacgtgcaggcctactttaaggttaacaccgatgactacgtcctgaattctaaggcttttaaccgtccgctgacaattactaaagaagttttcgacttaaataatgtcttgtatggcaaatacaagaaattccaaaagggatatttgactgcgactggcgataatgtaggctatacgcacgcagtcaatgtatggattaaattttgcatggatttcttggactcatacgacagtacgtgcatctatgatttctcgagccttaagcccgagtcgtatttgtcgttggatagtttttatcaggacgttaacctgttattatacaagctgagctttactgacgtgtcggcctcgtttatcgatcaattagtggaagaagggaaaatgtacctgtttcaaatttataacaaagacttttcagagtattcaaaggggactccaaatatgcacacgctgtattggaaggctttatttgatgagcgcaacttggcagacgtcgtttataagcttaacggacaagctgagatgttttatcgcaagaagtcgatcgaaaatacccacccgacacatcccgcaaatcatcccatcttgaataaaaacaaagataataagaagaaggaaagtctttttgagtatgatttaattaaagaccgccgttacacagttgataagttcatgttccacgtaccgatcacgatgaattttaaaagtagcggatccgagaacattaaccaagacgttaaagcttaccttcgccacgccgatgacatgcatatcattgggatcgaccgtggagaacgtcatctgttatacttggtcgtaatcgacctgcaagggaatattaaggagcaattttcattaaacgagattgtgaacgattataacggtaacacgtaccatacgaactaccacgatctgttggatgtccgtgaggatgaacgtctgaaggctcgtcagtcatggcaaactatcgaaaacattaaagagttaaaagagggttatttgtcccaagtaatccataagattacgcagttgatggtgcgttatcatgccattgtggttttggaggacctgtcaaaagggttcatgcgctcgcgccaaaaggtagaaaaacaggtttatcaaaagtttgagaaaatgctgatcgacaaacttaattacctggtagataaaaagacggatgtgagcactccggggggtctgttaaatgcttatcagctgacttgtaaatcagattccagccagaaattgggcaaacagagtggatttcttttttatatccccgcgtggaatacctctaagattgacccggtaacgggtttcgtaaacttgcttgatacacattcgctgaacagtaaggagaagatcaaagctttcttctccaaatttgatgcgattcgctacaacaaagataagaagtggtttgagtttaaccttgactacgataagtttggcaaaaaagcggaagatacgcgcaccaagtggacattgtgcactcgtgggatgcgcatcgacactttccgcaacaaagaaaagaatagccaatgggataaccaagaggtggatcttactaccgaaatgaaatcgttactggagcactattacatcgacatccatggaaacctgaaggacgcgatcagcacacaaacagacaaagccttctttactggcttgcttcacatcttgaagcttacgttgcagatgcgcaactctattacgggtacggaaactgattatttagtatctcctgttgctgacgaaaacggcattttctatgattcgcgttcttgcggagatcaattaccagagaatgcggatgctaacggcgcctacaacattgcccgtaaaggtttaatgttagtggaacaaattaaagacgccgaagaccttgacaacgtcaagtttgatattagtaacaaggcgtggcttaattttgcacagcaaaaaccatataagaatggctga

SEQ ID NO: 856 - DNA, 3921 bp, synthetic construct
  misc_feature 1..3921: note = Description of Artificial Sequence: Synthetic polynucleotide
  source 1..3921: mol_type = other DNA
atggcgaagaattttgaagacttcaagcgtctttacccattatctaaaacattacgtttcgaagctaaaccaatcggagcgacccttgataacattgtcaagtccgggcttctggaggaggatgagcaccgcgctgcctcgtatgttaaggttaagaagctgattgatgagtatcataaggtattcatcgaccgtgtccttgataacggatgcttgcctctggacgataaaggtgacaacaactcccttgctgagtactacgagagctacgtgtccaaggcgcaagatgaagacgccattaaaaaattcaaggagatccagcaaaaccttctgtcgattatcgccaaaaagcttacagatgataaagcttacgccaacttgtttggcaacaaactgattgagagctataaagataaagcggacaagacgaaattaatcgacagcgaccttatccagtttattaacacagccgagtcgacccaattggtcagcatgtcccaggacgaggccaaggagttggtaaaggaattttggggattcacaacttactttgagggttttttcaagaaccgtaaaaatatgtatacacctgaagagaaatctactggtattgcgtaccgcctgatcaatgagaacttaccaaaatttatcgacaacatggaggcctttaagaaggccattgcccgtccagagatccaggcgaatatggaagaactgtattccaattttagtgaatatctgaacgtggagtccatccaagagatgtttttattggactactacaacatgctgcttacccagaaacaaatcgatgtctataacgcgatcattggaggtaaaacggacgatgagcacgatgtaaagattaaagggatcaatgaatacatcaacctgtacaaccaacaacataaagacgataaattgcctaagttaaaggccttgtttaagcagattttatctgatcgtaatgccatcagttggctgcccgaagagtttaattcggatcaggaggtattgaacgctattaaagattgctatgaacgcctggctgagaacgtccttggggataaagtgttaaaatcactgcttgggtcactggcagattattcccttgatggtattttcatccgcaacgatttgcagcttacagacatctcacaaaaaatgttcggtaattggggtgtaatccaaaacgcgattatgcagaatattaaacatgtcgcaccggctcgtaagcacaaggaaagtgaagaagactacgagaagcgtattgccggtatctttaaaaaagccgattcgttttcgatttcgtacatcaatgactgccttaacgaagctgaccccaacaacgcctactttgtggaaaattattttgctactttcggtgccgtaaatacacctacaatgcaacgcgagaacttatttgcacttgtgcagaatgcatacacagaggtcgctgcactgttgcattctgactacccgacagttaagcaccttgcccaagacaaggccaacgtatcgaaaattaaggcgctgctggatgctatcaagtcactgcaacattttgtgaaaccgttacttggcaaaggagacgagtcagataaggacgaacgcttctacggagaacttgcttcgttgtgggccgaattagacacggtcacccccttatacaacatgatccgtaactacatgacacgcaagccgtatagccagaaaaagattaaacttaactttgagaatcctcaactgctggggggatgggatgcgaataaagagaaggattatgccacaattatcctgcgtcgtaatggcctttattacttagctattatggataaggactcacgcaaattattgggtaaagccatgccctctgatggtgagtgctacgagaaaatggtctacaaattcttcaaagacgtaactactatgatcccgaaatgcagtactcagttaaaggacgtacaggcttattttaaagtaaacaccgatgattacgtcctgaattccaaggcgtttaatcgtccacttaccattacaaaagaagtattcgatttgaacaacgtattgtacggaaagtacaagaagttccagaaggggtatctgaccgctacaggtgataatgtaggttatacacacgccgtgaacgtgtggatcaagttttgtatggattttctggattcatacgactccacttgcatttatgattttagctctcttaagccagaatcatatctttccttagacagtttctatcaggatgttaatcttcttttatacaaattgtcctttacggacgtttcagcgtcctttattgaccagcttgtagaggagggcaagatgtacctttttcagatctataacaaagacttttcggagtactctaaggggacacccaacatgcatacgttgtattggaaagccctgttcgatgaacgtaatcttgcggacgtcgtatacaagcttaacggtcaagcggaaatgttttatcgtaagaagtccattgagaatacccatccaacccacccggcaaatcatccaatccttaataaaaacaaggataataaaaaaaaggagtcgctgtttgagtatgacttaattaaggaccgccgctacacggtggacaagttcatgttccacgtcccaattacaatgaatttcaagtcaagtggttctgaaaatatcaatcaagacgtaaaagcataccttcgtcatgccgacgacatgcacatcatcggcattgaccgtggtgaacgccacttgctttatctggtcgtcatcgacttgcaaggcaacatcaaagagcaattctcacttaatgagattgtaaatgattacaatggaaacacatatcacactaattaccacgatcttctggatgtccgcgaagacgaacgtttgaaggcacgtcaatcctggcaaaccattgaaaatattaaggaactgaaggagggttatttatctcaagtaatccacaaaattacccaactgatggttcgttatcacgcgattgtagtcttggaggacctgtccaagggatttatgcgtagtcgccaaaaagtggagaagcaagtttatcaaaagttcgaaaaaatgttaattgacaaacttaactaccttgtcgataagaagaccgacgtgtccacccctggcgggttactgaacgcgtaccagctgacatgtaagtcagactcctctcagaaacttggcaagcagtcaggatttttgttttatatccctgcttggaacaccagcaagatcgatccggttaccggttttgtaaaccttctggatactcatagtcttaactcgaaggagaaaatcaaggcttttttctccaagttcgatgccattcgttataacaaagataaaaagtggtttgagttcaatttggactacgataagtttggaaaaaaagccgaagacacgcgcaccaagtggacgctttgtacgcgtggaatgcgcattgacacatttcgtaataaggaaaaaaactcacaatgggacaatcaagaagtagatttaacgacagaaatgaaaagtcttttggagcattactatattgatattcatgggaatcttaaggatgctatttccactcaaaccgataaagccttttttacggggcttttacacattttaaaacttaccttacaaatgcgcaactcgatcacggggaccgaaactgattatttggtgtctcctgttgccgacgaaaacggaatcttctatgactctcgctcttgtggggatcaattaccggaaaatgctgacgcaaatggcgcgtacaatattgctcgcaaggggttgatgttggtagagcagatcaaggacgctgaggatttggataatgtgaagtttgacatctctaataaagcgtggcttaatttcgcacagcagaaaccatacaaaaacggatga

SEQ ID NO: 857 - DNA, 3921 bp, synthetic construct
  misc_feature 1..3921: note = Description of Artificial Sequence: Synthetic polynucleotide
  source 1..3921: mol_type = other DNA
atggcgaagaacttcgaggacttcaagcgcttatatcctctgtccaaaacgcttcgttttgaagctaaaccgatcggtgcgaccttggataacattgtgaaatctgggctgttggaggaagatgagcaccgcgcagcctcgtacgtaaaagttaagaagcttattgatgagtaccacaaagtctttattgaccgtgtgttagataacggctgcttgcccttagatgacaaaggggataataactcgttagcagagtactatgaatcgtatgtaagtaaagcacaggacgaggatgcaattaagaaattcaaggaaatccaacagaatttattatccattattgctaaaaagttaaccgatgacaaagcttacgcgaacttgtttggcaacaagcttattgagagttataaggacaaggctgacaaaacgaagctgatcgactccgaccttatccagtttatcaatacagccgagtcaactcagttggtgtcaatgtcacaagatgaagcaaaggaacttgtgaaagagttctggggatttacaacttattttgagggattctttaaaaatcgtaagaacatgtacacgcccgaagaaaagtcgacgggaattgcgtatcgcctgattaatgaaaacctgccgaagttcattgacaatatggaggccttcaagaaggctatcgcacgccccgagatccaagctaacatggaagaactgtattcgaatttttcagagtacttgaacgttgaaagcatccaagagatgttcttgcttgattattacaatatgttgttaactcaaaaacagattgatgtgtacaacgcaatcattggtggcaaaaccgatgatgaacacgacgtgaaaatcaaagggattaatgagtacattaacttatataaccagcaacataaggacgataaattaccgaaattgaaagctctgtttaagcagatccttagtgatcgcaacgctatctcgtggctgccagaagagttcaacagcgatcaagaagttttaaatgcaatcaaagactgttacgaacgtttggctgaaaacgttttaggagacaaagttttaaagtcccttcttgggagcttggctgactactcattagacggtatttttatccgcaacgatcttcaattgacggacatctcacagaaaatgtttggtaattggggagtaatccaaaacgcaattatgcaaaatattaagcatgtggcgcctgcacgtaagcataaggagtcggaagaagattacgaaaagcgcattgcggggatcttcaagaaagctgactctttttcgatttcttatattaatgattgcttgaatgaggccgatcctaataacgcctactttgtagagaactattttgcgacttttggagcagtgaatacaccgaccatgcaacgtgaaaacttgtttgctctggtccaaaatgcctatactgaagtagccgcacttctgcattccgattatcctaccgtaaaacacctggcacaggataaagccaatgtgagtaagatcaaggctcttttggatgccattaagtctctgcagcattttgtaaaaccactgctgggaaaaggagatgagtcagataaagacgaacgcttttacggagaattagcgtcgctgtgggcagaactggacacagttactcctctgtataatatgatccgtaattatatgactcgcaaaccttattcacaaaagaagattaagctgaatttcgagaaccctcaattgttaggaggatgggacgctaacaaggaaaaagattatgctaccattatccttcgtcgcaatggattatattatcttgctattatggacaaagactcgcgcaaattgttagggaaagccatgccctccgatggcgaatgctacgaaaagatggtgtataaattctttaaggatgttacgaccatgattcccaaatgtagcacacaattaaaagacgtacaagcatacttcaaggttaacactgacgattatgttcttaactcgaaagcgttcaaccgccccctgaccatcaccaaagaagtatttgatttgaataacgttttgtatgggaagtacaagaaattccagaaaggatacttaactgctacgggtgacaatgttgggtatacgcatgcagtaaacgtttggattaagttctgtatggacttcttagactcctatgattcgacatgtatctatgacttcagcagcctgaagccagaatcatatctgtctctggattctttctatcaagacgtaaatcttctgctgtacaagttgtccttcactgacgtctcggcgagcttcattgatcagttggtggaggaaggcaagatgtacctttttcagatttacaacaaagacttcagtgagtatagcaaagggacccccaatatgcatacactttattggaaagcactgttcgacgagcgtaatctggccgacgttgtctacaagttaaacggtcaggctgaaatgttttatcgcaagaaaagtattgaaaatacacatcccacccatccggcgaaccatccaattcttaataaaaacaaggataacaaaaaaaaggagtcgctgtttgaatacgacctgattaaagatcgtcgttataccgtcgacaaatttatgtttcacgttcctattactatgaattttaaatcaagcggtagcgaaaacatcaatcaggatgtcaaagcgtatcttcgccacgcggatgacatgcacatcatcggtatcgaccgtggggagcgtcaccttctttacttagtcgtcatcgatctgcaaggcaacatcaaagagcaatttagcttgaatgagattgttaatgattataatggtaacacttatcatactaattatcatgacttgttagatgtgcgcgaggatgagcgtttaaaagcgcgccaatcttggcaaaccatcgagaacatcaaagaattgaaggaaggttacttatctcaagttattcacaagattacacagttaatggtacgttaccatgcgattgtggttttagaggacttatctaaagggtttatgcgttcgcgccaaaaagtggagaagcaagtctaccaaaagttcgagaagatgttgatcgataaattgaattatcttgttgataaaaagactgatgtgagtacgcctggtgggttattgaatgcctaccagttaacttgcaagagcgactcttcgcaaaagcttgggaaacagagcgggttccttttctatattccagcatggaacacttcaaagattgaccctgtaacgggctttgtaaacttgttagatacacatagtctgaatagtaaagagaagattaaagcattcttctcaaagttcgatgcaattcgctacaacaaggacaagaaatggttcgaatttaacttggattatgacaagtttgggaagaaagcagaggacactcgtacgaagtggactctttgcacacgtgggatgcgcatcgacacttttcgcaacaaggaaaaaaactcgcagtgggataatcaggaagtggacctgactaccgaaatgaaaagcttattagaacattactacattgatattcacggtaatctgaaagatgcaatctcaacccaaaccgacaaagccttcttcacagggttgcttcatatcttgaaacttacccttcaaatgcgtaactcgatcacagggactgagacggactatttagtctcacccgtggcagatgagaatgggatcttttacgattcgcgctcctgtggagatcaacttcccgagaacgctgacgcgaacggcgcttataatattgcacgtaaaggactgatgttggtggaacagatcaaggatgctgaggatttggataatgtcaaatttgacatcagtaacaaagcgtggttaaactttgcccagcaaaaaccctataagaacggttga

SEQ ID NO: 858 - DNA, 3921 bp, Prevotella copri
  source 1..3921: mol_type = genomic DNA
atggctaagaattttgaagattttaagagactttattctctttcaaagactttgcgctttgaagcgaagcctattggtgccactttggataatatagtcaaaagtggtttgctggatgaagatgaacacagagctgcaagctatgtgaaggtgaagaaattgattgatgaatatcacaaggtatttattgatagagtgttggatgatggctgtttgcctttggaaaataaaggtaataataattcattggcagaatattatgagagctatgtatctagagcgcaagatgaggatgcaaaaaagaagtttaaggaaatacagcaaaatcttcgttctgtcattgcgaaaaaactaaccgaagataaggcttatgctaatttgtttggtaacaaacttatagagtcgtataaggacaaagaggataagaaaaagataattgattcagatttgattcaattcatcaataccgcagaatcaactcaacttgattctatgtcacaagatgaggccaaagaacttgtgaaagaattctggggctttgttacttatttttacggcttctttgataatcgtaaaaatatgtatacggcagaagagaagtcaactggtattgcttatcgactagttaatgaaaaccttccaaaattcattgataatatagaggcttttaatagagctataaccagaccagagatacaggaaaatatgggagtcttgtattcagatttttccgaatacttaaatgtagaaagtattcaggagatgttccagcttgactattataatatgctccttactcaaaagcagattgatgtctataatgctataattggaggaaaaaccgatgatgagcacgatgttaagattaaaggtatcaatgagtatatcaatctctacaatcagcagcataaagatgacaagttaccaaaacttaaggctttgtttaagcagattcttagtgatagaaatgcaatatcttggttgccagaagagttcaatagtgatcaggaagtcttgaatgcaatcaaggattgctatgagcgattggctgaaaatgttttgggtgataaggttctcaagtctttgcttggttctttggcagattattctcttgatgggatatttatccgtaatgacttacagttgactgatatttctcagaaaatgtttggaaattggggcgtgattcagaatgctatcatgcagaatataaagcgtgtcgctcctgccagaaagcataaggagtctgaggaagattacgaaaaaagaattgctggtatattcaaaaaggcagatagctttagtatcagttatataaatgattgtttgaacgaagcagatcctaataatgcctactttgtagagaactattttgcaacatttggagcggtaaatactccaacaatgcagcgtgagaatctgtttgcgcttgttcaaaatgcgtatacagaagttgctgcattacttcattctgattatcctacagtaaagcatctggcacaagacaaggctaatgtttctaaaatcaaagcactgttggatgcaataaagtctttgcagcatttcgtgaagcctctgttgggcaagggtgatgaaagtgataaagatgaacgtttctatggtgaactagcttcgttgtgggcagaacttgatacagtgacaccgctgtataatatgattcgtaattatatgactcgtaaaccatattctcaaaagaagatcaaacttaactttgagaatcctcaattgcttggtggttgggatgctaataaggagaaagactatgctaccattatcttacgtcgtaatgggttgtattatcttgctattatggacaaagactcaaggaagttattgggtaaggcaatgccgtcagatggggagtgctatgagaaaatggtatataagttcttcaaagacgtgacaacgatgataccaaagtgtagtacacaattaaaagatgtacaagcttattttaaggttaatacagatgattacgtcttaaatagcaaggcgtttaacaagccattgacgataacaaaggaagtctttgatttgaacaatgtattgtatggtaagtataagaaattccaaaagggatacttgactgctactggtgataatgtaggttatacccatgctgtaaacgtatggataaaattctgtatggattttttgaacagctatgatagcacttgcatatatgatttctcttctttgaaaccagagtcatatttgtcgcttgatgcattctatcaagatgctaatttgttgttgtataaattgtcttttgcaagagcatctgtatcgtatatcaaccagcttgttgaggaggggaagatgtatctgttccaaatctacaataaggatttctctgagtatagcaaaggcactccaaatatgcatactctttattggaaagcattgtttgatgaacgtaatctggcagatgtagtttacaagcttaacggacaggcagagatgttctatcgtaagaaaagtatagaaaatactcatccaactcatcctgctaatcatcctattcttaacaagaataaggataacaagaaaaaagaaagcttgtttgactatgatcttataaaagatcgtcgctacactgttgataaatttatgttccatgtgccaatcacaatgaatttcaagagcgttggctcagagaatatcaatcaagatgtgaaggcgtatttgcgtcatgcagatgatatgcatattattggtattgatcgtggtgaacgtcatttgctttatctggttgttatagatttgcagggaaatatcaaggaacagtactcgcttaatgaaatagtgaatgagtataatggtaatacctatcataccaattatcacgatttgttggatgttcgtgaagaagaacgacttaaagctcgtcaaagttggcagaccatcgaaaatattaaagagctgaaagagggctatttgtctcaggttatccacaagattacacagctcatggttagatatcatgccattgttgttttggaagatctgagcaagggatttatgcgtagtcgtcaaaaggtagaaaagcaagtatatcagaagtttgaaaaaatgttgatagataagcttaactatttggtagacaaaaaaactgatgtttctactcctggaggcttgctgaatgcataccaacttacctgtaagtctgatagttctcaaaagttaggaaaacagagcggattcctgttctatatccctgcatggaatacatctaagatagacccagttacaggatttgtcaacttgttggatactcattctttaaattctaaagagaaaatcaaagctttcttctctaagtttgatgctatccgttataataaggataagaaatggtttgagtttaatctcgactatgacaagtttggtaaaaaagcggaagatacaaggactaagtggactttatgcaccagaggaatgcgtattgatactttcagaaataaagaaaagaactcgcagtgggataatcaggaagttgacttgacaacagagatgaaatctttattggagcattattatatcgacattcatggtaatctcaaggatgctatcagtgcgcaaacagacaaggccttctttacgggattgctacacattttgaagttgactttgcagatgcgtaatagtatcactggaacagaaactgattatctggtatctcctgttgccgatgagaatggaatattctacgatagccgttcttgtggtaatcaacttcctgagaatgcggatgctaatggtgcttataacatcgctcgcaagggactgatgctgattgagcaaatcaagaatgcagaggatttgaataacgtcaagtttgatatatccaataaggcttggctcaattttgcacaacaaaagccatataagaatggatga

SEQ ID NO: 859 - DNA, 3921 bp, synthetic construct
  misc_feature 1..3921: note = Description of Artificial Sequence: Synthetic polynucleotide
  source 1..3921: mol_type = other DNA
atggcgaagaatttcgaggacttcaaacgcctgtattctttgtctaagacacttcgttttgaggcaaagccgatcggagcgaccctggataacatcgtaaagtctggcttacttgatgaagatgagcatcgcgcggcgagctatgttaaggtaaaaaagttaatcgacgagtaccataaagttttcattgatcgtgttttagatgacggatgccttcctcttgaaaacaaaggtaataataacagcttggcggaatattatgagtcttatgtctctcgtgcgcaagatgaagatgcgaagaagaaatttaaggagatccaacaaaatcttcgcagcgtaattgctaaaaaactgactgaggataaggcctacgcgaacctgtttggcaacaagctgattgaatcttataaggataaagaagacaagaagaaaatcattgactcagatttaatccagtttatcaataccgctgagagtacgcaattagactctatgagccaagacgaggccaaagaacttgttaaggagttctgggggttcgtcacttatttctatggtttcttcgacaatcgtaaaaatatgtacactgctgaagagaagagtacggggatcgcttaccgcctggtaaatgaaaatttgcccaagtttattgacaacatcgaagcttttaatcgtgcgatcacacgtccggagatccaggagaacatgggggtgctttattccgacttcagtgaatatttgaatgtggaatcgattcaagaaatgttccagcttgattactataatatgttgttaactcagaagcaaatcgatgtgtataacgcaatcatcggtggaaagactgacgacgaacacgatgtaaagatcaaagggattaatgaatatattaacttatataatcaacaacataaagacgataaattgccaaagttgaaggcgttgtttaaacaaattctttccgaccgcaacgcgatctcgtggctgcccgaagagttcaactctgaccaagaggttttaaatgccattaaagactgttatgagcgccttgctgagaacgtcttaggcgacaaggtattgaagagcctgcttggttccctggctgattattcattagatggaatttttattcgtaacgatttgcagcttaccgatatctctcagaagatgttcggcaattggggggtcattcaaaatgcgatcatgcaaaacattaaacgcgtcgccccggctcgtaaacataaggaaagcgaggaggactatgagaaacgtattgccggaatcttcaagaaagctgactcgttcagtatctcctacatcaacgattgtttgaatgaagctgaccccaataatgcatactttgtagagaattacttcgcgacattcggggctgtaaacacacccacaatgcagcgcgagaatttgttcgcgttggtacagaatgcgtacaccgaagtcgctgcattattgcacagcgactaccccacggttaagcacttggcgcaagacaaagccaacgtctccaagatcaaggcgcttcttgacgctattaagtctttacagcattttgttaagccgttactgggcaaaggtgatgagtcggacaaggatgaacgtttctacggcgagttagcttcattatgggcggaactggacaccgttactcccttatataatatgatccgcaattacatgacgcgcaagccgtactcacaaaagaagattaagttaaactttgaaaatcctcaacttcttggaggttgggacgctaacaaagagaaggactacgccacgatcatcctgcgtcgtaacgggttatactatcttgcaatcatggataaagatagtcgcaagttgcttgggaaggctatgccatcggacggcgaatgttacgagaaaatggtgtataaattctttaaggacgtgacaacaatgatcccgaagtgctcgacccagcttaaagacgtccaagcttactttaaggtcaacacagatgactatgttctgaacagcaaggcttttaacaagccactgacaatcaccaaagaggtattcgatctgaataatgtcttatacggcaagtacaaaaaattccaaaagggatacttgacggcgactggtgacaacgtagggtacacccacgccgttaatgtgtggatcaagttttgtatggactttttgaacagctacgactctacctgcatttacgactttagtagcctgaaacccgagagttacttgtcattagatgcgttctaccaggacgccaatctgttgttgtacaaattgagctttgcgcgcgcttcagtctcctacatcaaccaattggttgaggagggcaagatgtacttgttccaaatttataacaaggacttttctgagtattccaaaggaacacctaacatgcacactttgtattggaaagcactgttcgatgaacgtaatttggcggatgttgtgtacaaattaaacggccaagctgagatgttctatcgtaagaaatctattgaaaacacccatccaacacatccggcgaaccatccgattttaaataaaaacaaggacaataaaaaaaaagagagtttatttgactatgatttgatcaaggatcgccgttacacagttgacaagtttatgttccatgtcccaatcacaatgaacttcaagtccgtggggtccgaaaatattaatcaagatgtaaaggcgtacttgcgccacgcagacgatatgcacattattggaatcgatcgtggagagcgccacttgctgtacttagtcgtaatcgatctgcagggcaatattaaagaacagtacagtcttaacgagatcgtgaacgagtacaacggaaatacgtatcacaccaactaccatgacctgttagatgtacgcgaagaagagcgcttgaaagcccgccagtcctggcaaaccattgagaatattaaggaacttaaagaggggtatctttcgcaggtgattcacaaaatcacgcagttaatggttcgttatcatgccatcgtggttctggaagatcttagcaaagggttcatgcgcagccgccagaaagtggaaaagcaggtctaccaaaaattcgagaagatgttaatcgacaaattaaattacttggttgacaaaaaaacagatgtatcaacacctggcgggctgcttaatgcatatcagcttacttgtaagagtgattcgtcccaaaaactgggaaagcagtctgggtttctgttttacattccagcttggaacaccagtaagattgacccagtaacaggcttcgtgaacttactggacacccatagtttgaactcgaaggagaaaattaaggcatttttctcgaaattcgatgctattcgttataataaagacaaaaagtggttcgagttcaatctggactatgataagtttgggaagaaagctgaggacactcgcactaaatggacgttatgtacgcgtggcatgcgcatcgatacgtttcgcaacaaggagaaaaattctcagtgggacaatcaggaagtggacttgaccacggaaatgaagagtctgttagagcattattatattgacattcatggaaaccttaaggatgctatctcagctcaaacagacaaggcatttttcacgggccttctgcacatcttgaagctgacgcttcaaatgcgcaattcgattacgggaactgaaaccgactatttggtgagtccggtcgccgacgaaaacggaattttttacgatagtcgttcttgtggaaatcagctgccggagaatgcagacgcgaatggggcctataatatcgcacgtaaaggactgatgttgatcgagcaaattaagaacgcggaggacttgaacaatgtaaaattcgacatctcgaacaaggcctggctgaactttgcacagcaaaaaccatataagaatggctga

SEQ ID NO: 860 - DNA, 3921 bp, synthetic construct
  misc_feature 1..3921: note = Description of Artificial Sequence: Synthetic polynucleotide
  source 1..3921: mol_type = other DNA
atggcgaagaatttcgaagacttcaagcgtctttactcactgtcaaaaactcttcgtttcgaagctaaaccgatcggcgccaccttggacaatatcgtaaagtccggccttttagatgaggacgaacatcgtgcagctagctatgtcaaagtaaaaaagctgatcgacgaataccacaaggtgttcattgaccgtgtgcttgatgatggttgtctgccactggagaataaaggtaataataactcgttagccgagtattatgagagctatgtgagccgtgcccaagatgaagacgctaaaaagaagttcaaagagatccaacagaacctgcgcagtgtaatcgcaaagaaacttacagaagataaagcctacgcgaatttatttggaaataagcttatcgaatcctataaagataaggaagacaagaaaaagattatcgatagcgaccttatccagttcatcaacacagccgaaagcacccagttagactctatgtcgcaagacgaggcgaaagaactggtcaaagaattctggggattcgttacgtatttctacggttttttcgataaccgcaaaaatatgtatacggctgaggagaaaagtacgggtatcgcctaccgcctggtgaatgagaatttgcctaagttcatcgataatattgaagcgttcaaccgtgcgattacgcgtccggaaattcaagaaaacatgggcgtcctgtatagcgacttcagcgaatatcttaacgtagaatcaatccaagagatgtttcaacttgattattataatatgctgttaacacagaaacagatcgacgtttacaatgctattattggaggtaaaacggacgacgaacacgacgttaaaattaagggcattaatgagtacattaacttatacaaccagcaacataaagatgataagctgccaaaactgaaagcattgttcaaacagattttgtctgaccgtaatgcaatcagttggcttccagaggagttcaattccgatcaagaggttcttaacgctattaaggattgttatgagcgcctggcagaaaacgtacttggggataaagtcttgaagagtcttttaggctcgctggccgactattcccttgacggtattttcattcgcaacgacttgcagttgactgatatttctcagaaaatgttcggaaattggggggtcattcaaaacgcgatcatgcaaaatattaagcgcgtcgccccggcacgcaagcacaaagagagcgaagaagactacgagaaacgcattgccgggatctttaagaaggccgactcattttctatttcttatattaatgattgtcttaatgaggcggatccaaacaatgcgtacttcgttgagaactattttgctacatttggcgctgtcaacacccctacgatgcagcgcgagaatctgtttgctttagtacaaaacgcatataccgaggttgcagcccttttgcattccgactatcctacggtgaaacatttagcacaagacaaagctaatgtctctaagatcaaggcgttgttggacgcgattaagtccctgcaacactttgtaaaaccattgctgggtaagggtgacgaatcagataaagacgagcgcttttacggggagctggcttcgttatgggcagaactggataccgtgactcccttatataacatgatccgcaactacatgacacgtaaaccatattcacagaaaaagattaagctgaactttgagaacccacagctgttgggcgggtgggacgcgaataaggaaaaagattatgccacaatcatcttacgccgtaacgggttgtactaccttgcaatcatggataaggactcacgcaaattattaggcaaggcgatgcctagtgacggcgaatgttacgaaaagatggtttataaattttttaaggatgttacaaccatgatcccaaagtgctccacgcagttaaaagacgttcaggcgtactttaaggtaaacacggatgactatgtactgaattcaaaggctttcaacaagcccctgaccatcacaaaagaggtttttgatcttaacaacgtgctttacggtaaatacaaaaaattccagaagggttacttgacggccactggtgacaacgttggttatacccatgccgtcaacgtatggatcaagttttgtatggacttcttaaattcttacgactcgacatgcatttatgatttttccagtctgaagccggagagttaccttagcctggatgccttttaccaggacgccaatttattgctttataagctgtctttcgcgcgcgcaagcgtgtcgtacattaaccaacttgtggaggaggggaagatgtacttgtttcagatctataataaggatttttctgagtattcgaagggtacccctaatatgcatacactttactggaaagctctttttgacgagcgtaaccttgccgacgtcgtgtacaagctgaacgggcaggcggaaatgttttatcgtaagaaatcgatcgaaaatactcaccctactcacccagccaaccatccgatcttgaataaaaataaggacaacaagaagaaggagagtctgtttgattacgacctgattaaagatcgccgttacaccgtagataaatttatgttccatgtaccgattactatgaacttcaagagcgtaggaagtgaaaatattaaccaggacgtaaaagcatacttgcgccatgccgatgatatgcacatcatcggtatcgaccgtggagagcgccatttactttatttggtagtgatcgatttgcaaggcaacatcaaagaacagtactcgttaaacgagatcgtgaacgaatacaacggaaacacgtaccatactaattaccacgacctgttagatgtccgcgaagaggagcgccttaaggcgcgccagtcgtggcaaactatcgagaatattaaagagttaaaggaagggtatctttcacaagtcatccataagattactcaattaatggtccgctaccatgccattgtagtcttggaggacctgagcaaggggtttatgcgctcacgtcagaaggttgaaaaacaagtctaccagaaatttgaaaaaatgctgattgataaactgaattacctggttgataaaaagacggatgtcagtacccctggcggtcttctgaatgcctatcaattaacatgcaagtcagactcttcgcagaagctggggaaacaatcagggtttttattttacattccagcgtggaacacaagcaagattgatcctgtcaccggttttgtcaaccttttggacacacatagtctgaactcgaaagaaaaaatcaaggcatttttcagtaagttcgatgcaatccgttacaacaaagataagaagtggttcgagttcaatcttgattacgacaagtttggcaagaaggctgaggatacgcgtacgaagtggacgctgtgtacccgtgggatgcgcattgacacattccgtaataaagagaaaaatagccaatgggacaaccaggaggtggaccttaccaccgagatgaagtccctgttggaacattactacatcgacatccatggtaaccttaaagacgcgattagcgcgcaaaccgataaggcctttttcacaggcctgctgcatatcttgaagttaactttgcaaatgcgcaattccattacagggacggaaactgattaccttgttagccccgtcgctgatgaaaatggcatcttctacgactcgcgtagttgcggaaatcagttaccggagaacgcggatgcaaacggggcatataatattgcccgtaagggacttatgttgatcgagcaaatcaaaaacgcagaggatcttaataacgttaaatttgatatttccaataaggcatggcttaacttcgcacagcagaagccgtacaaaaacggttga

SEQ ID NO: 861 - DNA, 3921 bp, synthetic construct
  misc_feature 1..3921: note = Description of Artificial Sequence: Synthetic polynucleotide
  source 1..3921: mol_type = other DNA
atggctaagaattttgaagatttcaagcgcctttactcgctgtcgaaaacgcttcgtttcgaagcaaaaccaatcggggctacgttggataacatcgttaagagtggcttgttggatgaggacgaacaccgtgccgcgtcgtacgttaaagtgaaaaagttgattgacgagtaccataaagtgtttatcgaccgtgtattggacgacggctgccttccactggagaataagggtaacaataattccctggcagaatattatgagagttacgtttctcgcgcgcaagacgaagatgctaaaaaaaagtttaaagagattcagcaaaatttacgctcggtcatcgctaaaaaattaacggaagacaaggcttacgcaaatttattcggaaacaagttaattgagtcgtacaaggacaaagaggacaagaaaaaaattattgattccgatttaatccagttcatcaatacggctgagagtacacaacttgattcaatgtcccaagacgaagcgaaggaactggtcaaagaattctggggttttgttacgtatttttacggatttttcgataatcgtaagaacatgtacaccgcagaggagaagtcaactggaattgcatatcgtttagtgaacgagaacctgccgaaatttattgacaatatcgaagcttttaaccgcgctattacacgtcctgagattcaggagaacatgggggttttgtactctgatttctccgaataccttaacgtcgaaagtatccaggagatgtttcagctggactactataatatgcttcttacgcagaaacagatcgacgtgtataatgcgattattggcggcaaaacagacgatgaacacgacgtaaaaatcaagggtatcaacgagtatatcaatctttataatcaacagcataaagacgataaactgccaaagctgaaagcgttgttcaaacaaattctttctgatcgtaatgccatttcctggcttccagaagagttcaacagcgaccaagaggtgttgaacgcaatcaaggactgttatgaacgtttggcggaaaatgtattaggagacaaggtccttaagtctttgttgggttcgttggcggattattcattagatggaatttttatccgcaatgaccttcaacttaccgatatcagccaaaagatgttcgggaactggggggtcattcagaacgcaattatgcagaatattaagcgcgtggccccggctcgtaagcacaaggaatctgaagaagactatgagaaacgtatcgcaggcatcttcaagaaagcagatagcttctctatttcatacattaatgattgcttaaatgaggctgaccctaacaacgcatacttcgtcgaaaattactttgctacttttggcgcagtgaacactcccactatgcagcgcgagaatctttttgcccttgtgcaaaatgcatacacggaggttgctgcattgttgcactctgattacccaactgtaaagcatttagcgcaggacaaagccaatgtatctaagattaaggctttattagatgcgattaagtccttgcagcattttgtgaaacctctgcttggcaaaggtgacgagtctgacaaggacgaacgtttttacggtgagctggctagcttatgggcagagctggacacagtcaccccgctttacaatatgatccgcaactacatgacacgcaagccctactcgcagaaaaagattaagttaaactttgaaaatccgcagttgcttggtgggtgggacgcaaataaagagaaggactatgctacgattatccttcgtcgcaacggtctgtactacttagcgatcatggacaaggattcgcgcaagttgcttgggaaagctatgccctcggatggtgaatgttatgagaagatggtttataaattctttaaggatgtgactactatgatccctaaatgttcgacccagttgaaagacgtccaggcttattttaaggtcaatactgatgactacgtcttaaacagcaaagccttcaacaagccattaacgattaccaaagaggtgttcgacctgaataacgtcctgtatgggaaatacaagaaatttcagaaagggtaccttactgcgaccggagacaatgtgggctacacgcatgctgtcaatgtctggattaagttttgtatggatttcttaaacagctatgactcaacatgcatttatgatttttccagtttaaaaccagaatcatatctgtctttagatgctttctatcaggatgctaatctgttgttatacaaacttagtttcgcacgtgctagcgtcagctacatcaaccaattagtcgaggaaggaaagatgtacttgttccaaatttacaacaaagattttagtgaatactccaagggcacgccaaacatgcacacactgtactggaaagcactgtttgatgagcgtaatctggcagatgtggtatacaaattgaatggccaagccgaaatgttctaccgcaaaaagtcgattgagaacactcacccaacccatcccgcgaaccacccaattttgaacaaaaacaaggataacaagaagaaggaaagtttgttcgactatgacctgattaaggaccgccgttacacggtggataaattcatgtttcatgtccccatcacgatgaactttaagtcggtcgggtcagaaaatattaatcaggatgttaaggcctatcttcgccacgctgacgacatgcacatcattggaattgaccgtggggaacgccatttgttgtatcttgttgtgatcgatctgcaagggaacattaaagagcaatattcgcttaatgagatcgtcaacgagtacaatggaaacacgtaccatacgaactatcacgaccttctggatgtgcgcgaggaggaacgccttaaagcacgccaaagttggcagacgatcgagaacattaaggaacttaaagagggctacctttcgcaggtaatccataaaattacgcaattaatggtgcgttaccatgctatcgtcgtgttggaggacttatccaaggggtttatgcgctctcgtcaaaaagttgagaaacaagtttatcagaaatttgagaaaatgcttattgataaactgaactacctggtggacaagaagacagatgtttccacgcctgggggtcttttgaacgcgtatcaattaacctgtaagtccgactcttctcaaaaattagggaaacagtccgggtttttattctatatccctgcgtggaatacttctaaaattgatcctgtaacaggcttcgtaaacttactggatacccattcactgaattcaaaagagaagattaaagcatttttctccaaatttgatgctattcgctacaataaagataaaaaatggtttgaatttaatttagactatgacaagtttgggaaaaaagcggaagatacccgtactaaatggacattgtgcactcgtggcatgcgtatcgacacctttcgcaacaaagagaaaaactcacagtgggataaccaggaggtagacttaacgacggagatgaagagtttgttggagcattactacattgatatccatggaaatctgaaggatgccatctcggcccaaaccgataaggcgttcttcaccggcctgttgcatatcttgaagttgacacttcaaatgcgtaactctattacaggtacagagaccgattatttggtttcacccgttgcggatgagaacggaatcttttatgattctcgctcgtgcggcaaccaacttccagagaatgccgatgcaaatggcgcgtacaatattgctcgcaaaggattaatgcttatcgaacaaatcaaaaatgcggaagatttgaataacgtaaaattcgacatctcaaacaaagcctggttaaatttcgcgcaacagaagccctacaagaacggttga

SEQ ID NO: 862 - DNA, 3825 bp, Prevotella copri
  source 1..3825: mol_type = genomic DNA
atggctaagaattttgaagattttaagagactttattctctttcaaagactttgcgctttgaagcgaagcctattggtgccactttggataatatagtcaaaagtgatttgctggatgaagatgaacacagagctgcaagctatgtgaaggtgaagaaattgattgatgaatatcacaaggtatttattgatagagtgttggatgatggctgtttgcctttggaaaataaaggtaataataattcattggcagaatattatgagagctatgtatctagagcgcaagatgaggatgcaaaaaagaagtttaaggaaatacagcaaaatcttcgttctgtcattgcgaaaaaactaaccgaagataaggcttatgctaatttgtttggtaacaaacttatagagtcgtataaggacaaagaggataagaaaaagataattgattcagatttgattcaattcatcaataccgcagaatcaactcaacttgattctatgtcacaagatgaggccaaagaacttgtgaaagaattctggggctttgttacttatttttacggcttctttgataatcgtaaaaatatgtatacggcagaagagaagtcaactggtattgcttatcgactagttaatgaaaaccttccaaaattcattgataatatagaggcttttaatagagctataaccagaccagagatacaggaaaatatgggagtcttgtattcagatttttccgaatacttaaatgttgagagtattcaggaaatgttccagcttgactattataatatgttgcttactcaaaagcagattgatgtctataatgctataattggtggaaaaactgatgatgaacacgatgttaagattaaaggtatcaacgattatatcaatctctacaatcagaagcataaagatgacaaattaccaaaacttaaggcattgtttaagcagattcttagtgatagaaatgcaatatcttggttgccagaagagttcaatagtgatcaggaagtcttgaatgctatcaaggattgttatgagcgattgtctgaaaatgttttgggtgataaggttctcaagtctatgcttggttctttggcagattattctcttgatgggatatttatccgtaatgacttacagttgactgatatttctcagaagatgtttggaaattggagcgtgattcaaaatgccattatgcagaatataaagcatgttgctcctgccagaaaacataaggaatctgaggaagaatacgaaaatagaattgctggtatattcaaaaaggcagatagctttagtatcagctatatagatgcttgtttgaacgaaacagacccaaataatgcctactttgtagagaactattttgcgacattgggtgcagtagatactccaacgatgcagcgtgagaacttgtttgcgcttgttcaaaatgcatatactgagataacagcattactccattctgattatccaactgagaaaaatttagcacaggacaaggctaatgttgctaaaatcaaagcattgttggatgcgattaagtctttgcaacatttcgtaaagcctctgttggggaagggagatgaaagtgataaagatgaacgtttctatggtgaattggcttcgttgtgggcagaacttgatacaatgacaccgctgtataatatgattcgtaattatatgactcgtaagccatattcccaaaagaagatcaaacttaactttgagaatcctcaattgcttggggggtgggatgcaaataaggagaaagactatgctaccattatcttacgtcgtaatggtttgtattatcttgctattatgaacaaagactcaaagaaattattgggtaaagcaatgccttctgatggggagtgctatgaaaaaatggtatataagttattgcctggtgctaataagatgcttccgaaagtgttctttgctaaatcaagaatggaagattttaagccaagtaaggaacttgttgagaaatattacaatggtactcacaaaaagggaaagaatttcaatattcaagattgccataatttgatagattactttaagcagtctattgataagcatgaagactggagcaagtttggatttaaattctcagatacttctacatacgaagaccttagtggattctatcgtgaagtagaacagcagggttataagttgtcttttgcaagagtatctgtttcgtatatcaaccagcttgttgaggaggggaagatgtatctgttccaaatctacaataaggatttctctgagtatagcaaaggtactccaaatatgcatactctttattggaaagcattgtttgatgaacgtaatctggcagatgttgtttacaagcttaatggacaggcagagatgttctatcgtaagaaaagtatagaaaatactcatccaactcatcctgctaatcatcctattctgaataagaataaggataataagaaaaaagaaagcttgtttggctatgatcttataaaagatcgtcgctatactgttgataaatttttgttccatgtgccaatcacaatgaactttaaaagttctggttctgagaacatcaatcaagatgtgaaggcgtatttgcgtcacgcagatgatatgcatattattggtattgatcgtggcgaacgccatttgctttatttggttgtaattgatttgcaaggaaatatcaaggaacagttctcgcttaatgaaattgtgaatgattataatggtaatacctatcataccaattatcacgatttgttggatgttcgtgaagacgaacgactcaaagctcgtcaaagttggcagaccatagagaatatcaaagagctgaaagagggctatttgtctcaggttatccacaagattacacagctcatggttaaatatcatgccatagttgtattggaggatttgaacatgggatttatgcgtggtcggcaaaaggtagaaaagcaagtatatcagaaatttgagaaaatgttgatagaaaagctaaactatttagttgacaagaaggctgatgcttctgtttctggaggtttgttgaatgcataccagttgactagcaagtttgatagtttccaaaagctaggaaaacagagcggattcctgttctatattcctgcatggaatacatctaagatagacccagttacaggatttgtcaacttgttggatactcgatatcaaaatgtagaaaaggcaaaaagtttcttctctaagtttgatgctatccgttataataaggataaggaatggtttgagtttaatctcgactatgacaaatttggtaaaaaagcagagggtacaaggactaagtggactttatgtactcgaggaatgcgtattgatactttcagaaataaagaaaaaaactcacaatgggacaaccaggaagtagacttgactgctgagatgaaatctttattggagcattattatattgacattcatagtaatctcaaggatgctatcagtgcgcaaacagacaaggccttctttacgggattgctacacattttgaagttgaccttgcagatgcgtaatagtatcactggaacagaaactgattatctggtatctcctgttgtcgatgagaatggaatattctatgatagtcgttcttgtggtgatgaacttcctgagaatgcggatgctaatggtgcttataatatcgctcgtaagggactgatgatgattgagcagataaaagatgctaaggatttggataacttgaagtttgatatttccaataaggcttggctcaattttgcacaacaaaagccatataagaatggatga

SEQ ID NO: 863 - DNA, 3825 bp, synthetic construct
  misc_feature 1..3825: note = Description of Artificial Sequence: Synthetic polynucleotide
  source 1..3825: mol_type = other DNA
atggcgaaaaatttcgaggacttcaagcgcttatactccttatccaagacgttgcgctttgaggcaaaaccaatcggcgccaccttagataatatcgtcaaatccgacttacttgacgaggatgaacatcgtgcagcttcttatgttaaagtcaaaaagttgattgacgagtaccacaaggtcttcattgatcgtgtcctggacgacggctgcttacccttagaaaacaaaggaaataataacagcttggctgagtattatgagtcctatgtgagtcgtgcgcaggatgaagacgcgaagaagaaattcaaagaaattcagcagaatctgcgctccgtaattgcaaaaaaattgactgaagacaaagcttacgcgaacttattcggcaataaattgatcgaatcatataaagacaaagaagataagaaaaagatcattgactccgatcttattcaatttatcaacaccgccgaatccacacaattggatagcatgagtcaggacgaggccaaagaactggttaaagagttttgggggtttgtcacgtatttttatggattcttcgacaaccgcaaaaatatgtatactgccgaagagaaatccacaggtattgcatatcgtcttgtcaacgagaacttacccaaattcattgacaatattgaagcctttaaccgcgctatcacgcgtccagaaattcaggagaacatgggcgtgttgtatagcgacttttcggaataccttaatgttgagtcgatccaggaaatgttccaacttgactactataacatgctgctgactcaaaaacaaatcgacgtttataatgcgattatcgggggcaaaaccgacgatgaacatgacgtaaagatcaagggcattaacgactacattaacctgtataatcagaaacataaggatgacaaattgccgaagttgaaggctttgttcaagcaaatcctttcggaccgtaatgcgatctcatggttaccagaagaattcaattcagatcaagaagttctgaacgccattaaggactgttatgaacgcctgtcggaaaatgttcttggggataaggttttaaagtctatgcttggctctcttgctgattattccttagacggtattttcattcgcaatgatctgcaattgacggacatcagtcagaagatgttcgggaactggtcggtcatccagaatgcgattatgcagaacattaagcacgtggcgccggcacgcaaacataaagagagcgaggaagaatatgaaaatcgtattgcgggtatttttaagaaagcggattcattttctatcagttatatcgatgcctgccttaatgagactgaccccaacaatgcgtactttgtagagaactatttcgcgactctgggggccgtggatacaccaaccatgcagcgcgaaaatcttttcgcgctggtacaaaacgcatacacagaaatcacggcgttgttacattctgactatccgaccgaaaaaaatttggcacaagacaaggccaacgtcgcgaaaatcaaggcgctgcttgacgctatcaaaagcctgcagcactttgtcaagcctttgttaggaaagggagacgaatcagataaagacgagcgcttttatggcgagttggcttcgttgtgggccgaattggataccatgacgcccctttacaatatgatccgcaactacatgactcgtaagccctatagccaaaagaaaatcaagttaaatttcgagaatccacaattactgggcgggtgggatgccaataaggagaaagattacgctacaattattttacgtcgcaacggcttgtactatcttgccatcatgaacaaagatagcaaaaagttactgggaaaagcaatgccttcggacggtgagtgttatgaaaaaatggtgtacaaacttttaccaggagctaataagatgttacccaaggtgtttttcgctaagagccgtatggaagacttcaagccctcaaaagaattagtggagaagtattacaatggaactcacaagaagggtaagaatttcaacattcaggattgccataatctgatcgactattttaaacaatctattgataagcatgaggactggagtaaatttgggtttaagttcagcgatacgtcgacatatgaggatctgtctggcttttaccgtgaagtggaacaacaaggctataaattgagtttcgcccgcgtctctgtatcatacattaatcaattggtggaagaaggcaaaatgtatctttttcagatctacaacaaagatttttcagaatattctaaagggacgcctaacatgcataccttatattggaaggctttgtttgatgaacgtaatctggctgacgttgtctacaaattaaacgggcaagcagagatgttttatcgcaagaagtctattgagaacacgcaccccacacaccccgccaatcaccctattctgaataagaacaaggacaataagaaaaaagaaagtttgttcgggtatgacctgatcaaagaccgccgttatacggtcgacaagtttcttttccacgtgccgattaccatgaattttaaatcttctgggtccgagaacattaaccaagacgtcaaggcctatcttcgccatgcggatgacatgcatattattggtattgaccgcggtgagcgtcatcttttatatcttgttgtcatcgatttacaaggcaatattaaagagcaattttcgttgaatgagattgttaatgactacaatggtaatacctatcacaccaattaccatgatcttttggacgtccgtgaggatgagcgtcttaaagctcgtcaaagctggcaaacgattgaaaatattaaggaactgaaagaaggttatttgtctcaggtcatccacaagatcacccaacttatggtaaaataccatgcaatcgtggtgttggaagatttgaatatgggtttcatgcgcggacgccaaaaggtagaaaaacaggtgtatcagaaattcgagaagatgttgattgagaagttgaactatttagtcgacaaaaaggcagatgcgtctgttagtggcggtctgttaaacgcttatcagttgacaagtaaatttgacagcttccaaaaactgggaaagcagtcaggtttcttattctacatcccggcctggaatacgagtaaaatcgatcctgtaacaggattcgtgaatttattagacactcgttatcaaaatgtagagaaggctaagtcgttctttagtaaatttgacgctatccgttataataaggacaaggaatggtttgaatttaacttggactacgacaagttcggtaaaaaagccgagggtacccgcactaagtggaccttatgtacacgtggaatgcgtatcgacacctttcgtaataaggagaaaaattctcagtgggataatcaggaggttgatttgacggctgagatgaagagtctgcttgagcattactatattgatattcattcgaatctgaaggacgcaatctcagctcagactgacaaggccttttttaccgggttacttcacatcttgaaattgacactgcaaatgcgcaatagtattaccgggactgaaactgactacttagtgagtccggtagttgatgaaaacggaattttctacgattcacgctcatgtggcgatgagttgccagaaaatgcggacgctaacggtgcttacaacatcgcccgtaaaggtttaatgatgatcgagcaaattaaagacgctaaggacttagacaatttgaagttcgatattagtaataaggcgtggttgaatttcgcccaacaaaagccgtataaaaatggttga

SEQ ID NO: 864 - DNA, 3825 bp, synthetic construct
  misc_feature 1..3825: note = Description of Artificial Sequence: Synthetic polynucleotide
  source 1..3825: mol_type = other DNA
atggcaaaaaattttgaagactttaagcgtttatacagtttgtccaagactttacgttttgaggctaaacctattggcgcaaccctggacaacattgtaaagtctgaccttctggacgaagatgaacaccgtgccgcctcttacgtaaaagtcaaaaaattgatcgacgaatatcataaggtcttcatcgatcgcgtgcttgacgacggctgtttacctctggagaataaaggtaataacaattccctggctgaatattacgaaagctacgtcagtcgcgctcaagacgaagacgcaaaaaaaaagttcaaggaaattcaacaaaatcttcgctccgtgattgccaagaagctgacagaagataaggcatacgccaacctgttcggtaacaagttgatcgagagttacaaagataaagaggacaagaagaaaatcatcgatagcgatctgatccaattcatcaatacagcggagtcaacccagctggactctatgtcccaggatgaagctaaagaacttgtgaaggaattctggggtttcgtaacctatttttatgggttcttcgacaatcgcaaaaatatgtacactgccgaggaaaagtcaacaggaatcgcatatcgcttggtgaatgagaatttaccaaaatttatcgacaatattgaggccttcaatcgcgcgatcactcgtccggaaattcaggagaacatgggtgtcttatactctgatttctcggagtaccttaacgtagaatctatccaggaaatgtttcagcttgattactacaatatgctgttgacacagaaacagattgacgtgtataatgcgatcattggtgggaagaccgatgacgaacatgatgtcaagattaaagggatcaatgactacattaacttgtacaatcagaaacataaagacgacaagttgccgaagttgaaggctttatttaagcaaatcctttcggatcgtaacgctatctcgtggttacccgaggagttcaatagcgatcaagaagtcttgaatgcaattaaggattgttatgagcgcttatcagagaacgtattaggagacaaagttcttaaaagcatgttgggctcgcttgctgactacagtttggatggcattttcattcgtaacgatttgcaattaacagatatttcgcaaaaaatgttcggaaattggagcgtcatccagaatgctatcatgcaaaacatcaagcacgtggctcccgcacgtaaacataaagagtctgaagaagagtatgaaaatcgcattgctggaatttttaaaaaggcagatagctttagtatttcctatatcgacgcgtgtttgaatgagacggacccaaacaatgcctatttcgtagagaattattttgctaccctgggggcagtagatacaccgacaatgcaacgtgaaaatctttttgcgcttgtccagaatgcgtacacagaaatcacggcgctgttgcactctgactatcctactgaaaaaaatcttgcgcaggacaaggccaacgtggcaaaaatcaaggcacttcttgatgctattaaaagcttacaacacttcgttaagcccctgctgggcaaaggggacgaaagtgataaagacgagcgcttttatggggagttagcttcgctgtgggctgagctggataccatgacgcctttatataacatgatccgcaactacatgacacgcaaaccttattcacaaaagaagatcaagcttaattttgaaaatccgcagttgctggggggatgggatgcgaataaagagaaggattatgccaccattattcttcgtcgtaatggcttatactatttggcaatcatgaataaggactccaagaagttgctgggcaaagctatgccgagcgatggagaatgctatgagaaaatggtctataagttgttaccaggtgcgaacaagatgttaccaaaggtttttttcgcaaagtcgcgcatggaagattttaaaccttccaaagaattagtagaaaaatattataacggcacgcacaagaagggcaagaatttcaatattcaggactgtcacaatctgattgattactttaaacagtcgattgataaacacgaggattggtctaaatttggttttaagtttagcgatacctcgacttatgaagacctgtcaggattttatcgcgaagtcgagcagcagggatataagttgtcatttgctcgtgttagcgtatcgtatattaatcagttggtagaagaggggaagatgtatcttttccaaatctacaataaggatttttcggagtattcaaagggaacaccaaatatgcacaccctgtattggaaggctttattcgacgagcgcaatcttgcagacgtcgtctataagcttaatggacaagcggaaatgttctaccgcaaaaagtccattgagaatacacaccccacgcacccggctaatcacccgattctgaataaaaacaaagacaacaaaaaaaaggaaagcttatttggctacgacttaatcaaagaccgccgttacacagtagacaagttcttgtttcacgtgcctattacaatgaattttaaaagtagcggttcagagaatattaaccaagacgtgaaagcgtacttacgtcatgccgatgatatgcacattatcggtattgaccgcggagaacgtcacttattgtacttggtggttattgatttacaagggaacatcaaagagcagttcagtttgaacgagatcgtgaatgactacaatggtaatacgtatcatactaactaccatgatcttttggacgtgcgtgaggatgagcgcctgaaagcccgtcagagctggcagaccatcgagaatatcaaagaattgaaggaaggctacttatcgcaggtcattcataaaatcacgcaactgatggtgaaataccacgcgattgttgttttggaagatctgaatatggggtttatgcgtggccgtcagaaagtggagaagcaagtttaccagaaatttgaaaagatgttgattgagaagttaaattacttggtagacaagaaagcagacgcgtctgtatctggaggtttgcttaacgcataccagttgacgtcaaagtttgatagttttcaaaaattagggaaacaatccggatttctgttctacattcccgcatggaacacgtcaaaaattgacccggtgaccggcttcgttaacttattggacactcgttaccaaaatgtggagaaagccaagtcttttttctctaaattcgacgcgattcgttacaacaaggataaagaatggtttgagtttaacttggattatgataagtttgggaagaaagcagaaggaacgcgtactaaatggacactttgtacacgtggaatgcgcatcgatacgttccgcaataaagaaaagaactcccaatgggacaatcaagaggttgatttaactgcagaaatgaagagtttacttgagcattactacattgatatccactcaaaccttaaagatgcaatctctgctcaaactgataaagcgtttttcacgggattactgcatatccttaagttaacgttacagatgcgcaatagtatcaccggtactgaaacagattatcttgtctctccggtagtggacgagaacggcattttttacgacagtcgttcgtgcggggacgaattgcctgagaatgcggatgctaatggggcgtataacattgcgcgcaaagggcttatgatgatcgaacagatcaaagacgctaaggacctggataacttgaagtttgatattagcaataaggcttggctgaacttcgctcagcaaaaaccatataagaatggctga

SEQ ID NO: 865 - DNA, 3825 bp, synthetic construct
  misc_feature 1..3825: note = Description of Artificial Sequence: Synthetic polynucleotide
  source 1..3825: mol_type = other DNA
atggccaagaactttgaggactttaagcgtttgtactccttaagcaagaccctgcgtttcgaggcgaagccaattggggctacgttggataacatcgtcaaatctgatttgttggatgaagacgagcaccgtgcagcttcgtatgtaaaagtaaaaaagttaattgatgagtatcacaaagtattcatcgaccgcgtactggacgacggatgcttacccttagagaacaaaggcaacaacaattctttggcggaatactatgaaagctatgtaagtcgtgctcaggatgaggatgcgaagaagaagtttaaagaaattcaacagaacctgcgctcagtgatcgcaaaaaaattgacggaggacaaggcctatgctaatttgttcgggaataaacttattgaatcatataaagataaagaggataagaagaaaattattgatagcgatctgattcagttcatcaatacagcggaatcgacgcaattggatagtatgtcgcaggacgaagcaaaggagttggtcaaagaattttggggcttcgttacttacttctacgggtttttcgataaccgtaaaaacatgtatactgcggaagaaaaatccactgggattgcctatcgtctggtgaatgagaatctgccaaaatttatcgacaatatcgaggcttttaatcgtgcaatcacacgccccgagattcaggaaaatatgggggttttatattcggattttagtgagtatctgaatgttgaatctatccaggaaatgtttcagcttgactactacaatatgctgcttactcaaaagcagatcgatgtttataatgcaatcattggaggcaagactgatgacgaacatgatgtaaagattaaaggtatcaatgactatatcaatttatacaaccagaaacataaggacgataaattgccaaaacttaaagctctttttaagcagattctttcagaccgtaatgcaatttcatggcttccggaagaattcaattccgaccaggaggtcttaaacgcgattaaagactgttatgagcgtttaagtgaaaacgttttaggtgataaagtacttaagtcaatgttgggatcgcttgcagattattccttagacgggatctttattcgtaacgaccttcagcttacggatatctctcaaaaaatgtttgggaattggtccgtcatccaaaacgccatcatgcaaaatattaaacacgttgcccctgcgcgtaaacacaaggaaagtgaggaagagtatgaaaaccgtattgcgggaatctttaaaaaagcagattctttttcaatcagctatattgatgcctgcctgaacgagactgaccccaataatgcttacttcgtagaaaactatttcgccactttgggtgcggtagacacccctacaatgcagcgtgagaacttgtttgcgctggtgcaaaacgcgtatacggaaattacagctcttcttcattcggattaccctactgaaaaaaaccttgcccaggacaaagccaacgtggcaaaaatcaaagcgttactggacgcaatcaaatctttgcaacattttgtaaaacctctgctggggaaaggcgatgagagcgataaggatgagcgcttctatggcgagctggcaagcctttgggctgagcttgacacgatgacgccgctttacaacatgattcgcaattatatgacccgcaaaccgtatagtcaaaaaaagattaagttaaactttgaaaacccccagctgctgggcgggtgggacgctaataaagagaaagactatgcgacaattatccttcgtcgcaatggcctgtactacttagcaatcatgaataaggactcaaagaagcttttgggcaaggcaatgccgtcggatggcgaatgttatgagaagatggtttacaagttactgcccggcgccaataaaatgttaccaaaggtctttttcgcaaagtcccgcatggaagatttcaagccctccaaagagttagttgagaagtactacaatggtactcataaaaaggggaaaaacttcaatatccaagactgccacaatcttattgattactttaagcagtccattgacaaacacgaggattggagcaagttcggtttcaagtttagtgatactagcacctatgaagatctttcgggtttctaccgcgaagtcgaacaacagggctacaagttaagttttgcccgtgttagtgtgagctacatcaaccaactggtggaagagggcaaaatgtatctgtttcaaatttataataaagatttctctgaatattccaagggcactccaaatatgcacactctgtactggaaagcattatttgacgagcgcaatcttgcagatgtggtctacaaattgaacgggcaggcggaaatgttctatcgcaagaaaagtattgaaaatacacacccgacacaccctgcaaaccacccaatcttgaacaaaaacaaagacaacaaaaaaaaggagagtttattcgggtacgatctgatcaaggatcgtcgctatacggttgacaaatttcttttccatgttccaattactatgaacttcaaaagctccggctccgagaacatcaaccaagacgttaaagcgtatctgcgtcacgcggacgacatgcatattattgggatcgatcgtggcgaacgtcatctgttatatttagttgttattgatttgcaaggtaatatcaaggaacagttctcattgaatgaaattgtcaacgactacaacggtaacacctatcacactaattaccacgacttgttagacgtccgtgaagatgagcgtcttaaagcacgccagagttggcagacaattgagaacatcaaggaactgaaagagggctaccttagtcaagtgattcacaaaattacccaactgatggttaaataccacgcaatcgtagtcttagaggaccttaacatggggttcatgcgtggtcgtcaaaaagtcgaaaagcaagtatatcaaaaattcgaaaagatgcttatcgaaaaattaaactacttagtggataagaaggctgacgcttcagtctctggtggattgttaaacgcctatcagctgactagcaagttcgacagctttcaaaaattaggcaaacagtccggtttcttattctacatcccggcatggaataccagtaaaattgatcctgtaaccggtttcgtgaacttattggacactcgttaccaaaatgttgagaaagctaaatctttctttagtaaattcgacgctattcgttataataaggataaggagtggttcgaattcaacttggactatgataaatttggcaaaaaagccgaaggtacgcgtactaaatggaccctttgcactcgcggcatgcgtatcgatacatttcgtaacaaggagaaaaactcgcagtgggataatcaagaggtcgatctgacggccgagatgaaatcattattagagcattattacattgatattcactcgaatcttaaagacgccatttcagcccagaccgataaagccttttttacaggcttattacatatcttaaaattgacgttacaaatgcgtaactcgatcactggaactgagactgactacctggttagccccgtggttgatgaaaacgggatcttttacgattcacgtagttgtggggatgaattgccagagaatgctgatgcaaatggtgcatataacatcgcccgcaaaggtcttatgatgattgaacaaattaaagatgcaaaagacctggataatttgaagtttgacattagcaacaaggcctggcttaactttgcacagcaaaaaccttataagaatggatga

SEQ ID NO: 866 - DNA, 3756 bp, Moraxella bovoculi
  source 1..3756: mol_type = genomic DNA
atgttgtttcaagactttacccatttatatcccttatcaaaaaccgtgcgttttgaattaaagcccattggcaggacattagagcatatccatgccaaaaactttttgagccaagatgagaccatggcggacatgtaccaaaaggtgaaggtgatactcgacgattatcatcgtgattttatcgctgatatgatgggcgaagttaagctaactaagctggcagaattttatgatgtgtatttaaaatttagaaaaaatcccaaagacgatgaattgcaaaaacagctaaaggacttgcaagcagttttaagaaaagagagtgtgaagcccatcggtaatggcggaaaatacaaggcgggtcatgaccgcttgtttggggcaaagctctttaaggacggcaaagagcttggtgatttggcaaaatttgtcatcgcccaagagggtaagtcatcgccaaagcttgctcaccttgcccattttgagaagtttagcacttactttactggttttcatgataaccgcaaaaacatgtacagcgatgaggataaacacaccgccattgcctatcgtctgatacatgaaaacctgccacgttttattgacaacctacaaatactgacaaccatcaaacaaaagcactcggcgttgtatgaccagattataaatgagctgactgcgagtggcttggatgtgtcgctggcaagtcatctggacggctatcacaagcttttaacccaagagggtatcacggcttataataggataataggtgaagtgaatggttatacgaataagcacaatcaaatttgccacaaatccgaacgtatcgccaaattacgccccctacacaaacaaatcctaagcgacggcatgggtgtgtcatttttgccaagcaaatttgctgatgatagcgagatgtgtcaagcggtcaatgaattttaccgccattatgccgatgtttttgccaaggtgcaaagcttgtttgatgggtttgatgaccatcaaaaggacggcatttatgttgagcataaaaatttaaatgaactatccaagcaggcatttggtgattttgccttgttgggtcgggtgctggacggctattatgtggatgtggtgaatccagagtttaatgaaagatttgccaaagccaaaaccgacaatgccaaagcaaaactgactaaagaaaaagacaaattcatcaaaggcgtacactccttggcaagccttgagcaggcgataaagcatcatactgctaggcatgatgatgagtctgtgcaggcgggcaaacttggacagtatttcaaacacggtctggcaggcgtggataatccaatccaaaaaatacacaacaaccacagcaccattaagggttttttggagcgtgaacgtccagcaggcgagcgagcattgcccaaaattaagtcaggcaaaaaccctgaaatgacgcagttaagacagctaaaagagctgctagacaatgccctaaacgtggcgcattttgccaagttattaatgaccaaaaccacgctagacaaccaagacggcaatttttatggtgagtttggggtgttgtatgatgagcttgccaagattcccacgctttataacaaagtgcgcgattatctgtcgcaaaagccatttagcaccgaaaaatataaattaaactttggcaatccgacattattaaacgggtgggatttgaataaagaaaaagataattttggggttatcttacaaaaagacggctgttattatttggcgttattagataaagctcataaaaaagtatttgataatgctccaaatacaggcaaaaatgtttatcaaaaaatgatttataaattattgcccggacctaataaaatgctacccagagtattttttgccaagagtaatttggattattataacccttctgctgaactactggataaatatgcacaaggcacgcacaaaaaaggcgataattttaatctaaaagactgccatgcgttgattgatttttttaaggcgggtattaataaacatccagaatggcaaaattttggttttaaattttcgccaaccagtagctatcgagatttgagtgatttttatagagaagtcgaaccacaaggttatcaagtaaaatttgtggatatcaacgccgattatattgacgagttggttgaacaaggtcagttgtatttattccagatttataataaagatttctcgcccaaggctcacggtaagcctaatttacatactttatattttagggcgttatttagtgaagataatcttgccaatccgatttataagttaaatggcgaggcacagatattttatcgcaaggcgtctttgggtatgaatgaaaccaccattcatcgtgcaggcgagatattagaaaataaaaatcccgataatcccaaagaacgtgtatttacctatgacatcatcaaagatagacgctatacccaagataagtttatgctacatgtgcctattaccatgaattttggcgtgcagggcatgacgattaaagaatttaataaaaaagtgaatcaaagcatacggcaatatgatgatgtcaatgtcataggcatagaccgtggcgagcgacatttgctatatctgaccgtgattaatagcaaaggtgaaatcttagaacagcgtagtctcaatgacatcactaccgcatcagcaaatggcacacaaatgaccacgccttatcataagatactggacaaaagagaaatagaacgcctaaatgctcgtgtcggttggggtgagattgagaccataaaagagctaaaatcgggctatctaagccatgtggtacatcaagtcagccagcttatgcttaaatataatgccattgtggtattagaggatttaaattttgggtttaagcgtggtcgctttaaggtggaaaaacaaatttaccaaaactttgaaaacgccttaatcaaaaagctaaaccatttggaattaaaagataaggcagatgatgagattggctcatacaaaaatgccctgcaattgaccaataattttactgatctaaaaaacattggcaaacaaacaggctttttattctatgtgcctgcatggaataccagtaaaatagaccctgaaacgggctttgtggatttgttaaaaccacgttatgaaaatatcgctcagtcgcaagcgttttttggtaaatttgataagatttgttataacgcagataaggattattttgaatttcatattgattatgccaaatttactgacaaagccaaaaactctcgccaaacatggacgatttgctcgcatggcgataaacgttatgtgtatgacaaaaccgccaatcaaaataaaggagcgaccaagggtattaatgttaatgatgaattaaaatcgctatttgctcgctatcacatcaatgaaaaacagccaaatttggtcatggatatttgccaaaataacgacaaagaatttcataaatcgctgatgtatctattaaagacattgcttgcattacgatatagtaacgccagtagcgatgaagattttattttatcgcctgtggcaaatgatgagggtgtgttttttaattcggcattggcggatgatacacagccacaaaatgcggatgccaatggggcatatcatatcgcattaaagggcttatggctattaaatgagctaaaaaacagtgatgatttgaataaagtcaaacttgccattgataatcaaacatggctaaacttcgctcaaaaccgctaa

SEQ ID NO: 867 - DNA, 3756 bp, synthetic construct
  misc_feature 1..3756: note = Description of Artificial Sequence: Synthetic polynucleotide
  source 1..3756: mol_type = other DNA
atgttatttcaggatttcacgcatttatatcctttaagcaagacagtccgttttgaattgaagcctattgggcgcacccttgagcacatccatgcaaagaattttttatcgcaggatgaaacaatggcggatatgtaccagaaagtgaaggttatccttgatgactaccatcgcgactttattgctgacatgatgggggaggtcaaattgacgaagttagcggagttttatgacgtctaccttaaatttcgtaaaaatccaaaagacgacgaactgcagaaacagctgaaagatttacaggcggtattacgtaaagaatcggtcaagccaatcggtaatggtggcaagtacaaagcaggccatgatcgtttgtttggtgctaaacttttcaaggacggtaaagaactgggcgacttagctaaatttgtcattgctcaagaagggaagtcaagtcctaagttagcccacctggctcattttgagaaattctccacttacttcacggggtttcacgacaatcgtaagaacatgtatagtgatgaggataaacatacggcaattgcgtaccgtctgattcacgaaaacttacctcgtttcattgataaccttcaaatccttactaccatcaaacagaagcattctgcgttgtacgatcaaatcattaatgaactgaccgcgtccggtttagatgtaagccttgcgtcacacctggatggatatcacaaattattgactcaggaagggattactgcctacaaccgtatcattggggaggtcaatgggtatactaacaaacataatcagatttgccataagtctgaacgtattgccaagttgcgtccgctgcataagcagatccttagcgatggtatgggtgtctcctttttgcctagcaaattcgcagacgacagtgaaatgtgccaagcagtcaatgaattttatcgtcactatgcggatgtctttgcaaaagtgcaaagccttttcgacggtttcgatgatcaccaaaaagacggaatttatgttgagcataaaaatcttaacgagttaagtaagcaggctttcggtgatttcgccctgctggggcgtgttttagacggttactatgtggatgttgttaatcccgaatttaacgagcgcttcgctaaagccaaaactgacaacgctaaggctaaactgactaaagaaaaggacaagttcattaaaggcgttcattcactggcaagcttagaacaagccatcaaacatcacacggcgcgtcatgatgacgagtcggtgcaggctggtaagttagggcagtactttaagcacgggctggcaggagtagataacccaattcaaaaaattcacaataatcattcgactattaaaggatttctggaacgcgaacgcccggccggagaacgtgctttgcccaaaattaaatcgggaaagaaccctgaaatgactcagcttcgtcagctgaaagaattactggacaacgccttaaatgtagcccattttgcaaagttattaatgacgaagaccacgttagacaatcaagacggtaacttctacggtgagttcggcgtcttatacgatgaacttgcaaaaatccctacactttacaacaaagtgcgcgattatctttcccaaaagccattcagcaccgagaagtataagttaaatttcggcaatccaacgttacttaatgggtgggatcttaacaaagaaaaagacaacttcggtgtcattcttcaaaaagacgggtgttactacttggccttacttgataaagcccataagaaagtttttgataacgcccccaatactgggaagaacgtatatcaaaaaatgatttataagttgttaccggggcctaataaaatgttacctcgtgtatttttcgcaaagagtaatttggattattataacccctctgccgagttattggacaagtacgcgcaaggcacacataaaaagggtgataactttaacctgaaagattgccatgctttgatcgacttctttaaggcgggtattaacaagcaccccgagtggcaaaattttggtttcaagtttagcccgacctcctcctaccgtgacctgagtgacttctaccgcgaagttgaaccacaaggctatcaagtcaaattcgttgatattaacgcagactacattgatgaattagtcgagcaaggtcagttatacctgttccagatttacaataaagatttctcgcctaaagcccacggaaaacctaaccttcacacgctttattttcgcgcacttttcagtgaggataatttggctaaccctatttataagttaaatggtgaagcccaaattttctaccgtaaagcctccttggggatgaacgagacaactattcaccgtgcaggggagatcttggagaacaaaaatccggacaacccaaaagagcgtgtttttacttatgacattatcaaggaccgtcgctacacacaagacaagttcatgcttcatgttccgatcacgatgaatttcggcgtgcagggtatgacaatcaaggaatttaacaagaaagtgaaccaaagtattcgccagtatgatgatgtcaacgtgattggaattgaccgcggggaacgtcatttattgtacctgaccgtgattaatagcaaaggagagatcctggaacaacgcagcctgaatgatatcacaacagcctcagcgaacggaacccaaatgacaacaccctatcataagattctggataagcgcgaaatcgaacgcttaaatgctcgtgtcggctggggtgagatcgagacaatcaaggagctgaaatccggctacctgtcgcatgtagttcaccaagtctcacaattgatgcttaagtacaacgcaattgtagttcttgaagatttaaactttggttttaaacgtggccgctttaaggttgaaaagcagatctaccagaactttgaaaacgcccttatcaaaaaattaaatcaccttgagttgaaagacaaagcggacgacgaaatcggttcatacaaaaatgcattgcaattgacgaacaattttaccgatctgaaaaatattgggaaacagacgggtttcttgttttatgtccctgcgtggaacacgtctaagattgacccggagacagggtttgtcgacttattaaaaccacgctacgagaatattgcacagtcccaggcctttttcggaaagtttgataagatttgctataacgcagataaagattactttgagttccacatcgattatgccaaatttaccgacaaggcaaaaaattcccgtcaaacctggacaatttgctcgcacggcgacaaacgttacgtttatgacaaaacggcgaatcaaaataaaggcgctactaaggggatcaacgtaaatgacgagttaaaatcattattcgcccgctaccatattaacgaaaagcaaccaaatttagtgatggacatctgccaaaacaacgacaaggagttccacaagtctcttatgtatcttctgaaaacacttttggcgcttcgctactcgaatgcgtcgtccgatgaggacttcatcttatctccggtggctaatgacgagggtgtctttttcaattctgcattggccgatgacacgcaaccgcagaacgctgacgccaacggggcatatcacattgcgttgaaaggcctttggctgctgaacgagttaaagaattccgacgatctgaataaagtgaagctggccattgacaaccaaacgtggcttaatttcgcacaaaatcgctaa

SEQ ID NO: 868 - DNA, 3756 bp, synthetic construct
  misc_feature 1..3756: note = Description of Artificial Sequence: Synthetic polynucleotide
  source 1..3756: mol_type = other DNA
atgctgttccaggattttacccacttgtaccctctgagcaagacggttcgttttgaattgaagcctattgggcgcactttggagcatattcacgcaaaaaatttcttgtcgcaagacgaaactatggcggacatgtaccagaaagtcaaggtgatcctggatgattatcatcgtgactttatcgcagatatgatgggggaggttaaacttaccaaattagctgaattctatgacgtctacttgaagttccgcaaaaacccaaaggacgatgagttgcaaaaacaacttaaggacttacaagctgtccttcgtaaggagagcgtgaaaccaattggtaacggcgggaaatacaaggctgggcatgaccgtttgtttggagcgaaactttttaaggatggtaaggaacttggagatcttgccaaatttgttattgcccaggaagggaaatcctcgcccaaattagcgcaccttgcccacttcgagaagtttagcacatactttacggggtttcatgataaccgcaagaatatgtactcggatgaagataaacataccgctattgcttaccgcctgattcacgagaatttaccgcgctttatcgataaccttcagattttgactacaattaaacagaagcatagtgcattgtacgatcagattatcaacgagcttacagcgtccggtcttgacgtaagcttggcatcccatctggacggatatcataaattattaacacaggaagggattacagcatacaaccgcattattggagaagttaacgggtatacaaataaacataaccagatctgccacaagtcagagcgcattgcaaaacttcgtccccttcataaacaaatccttagtgacgggatgggcgttagtttcttgcctagtaaattcgcggacgattccgaaatgtgtcaagcggtaaacgaattttaccgccactatgctgacgtttttgcaaaggtacaaagtttattcgatggtttcgatgaccaccaaaaggacggtatctatgttgaacacaagaacttaaatgagttatctaaacaggcattcggtgattttgccttattgggccgtgtcttggacggttactatgtggatgtggtaaacccagaatttaatgagcgttttgctaaggccaaaacagataacgcgaaggcgaagttaaccaaagaaaaggataaatttatcaagggtgtacatagtttggcctccttggaacaagctatcaaacaccatacggcgcgtcatgacgatgagtctgtccaagctggcaaattggggcaatacttcaagcacgggttagctggtgtggataatcctatccaaaagatccataataaccattcaactattaaaggtttcttagaacgtgaacgtcccgcgggagaacgtgcactgcctaagattaaatcgggtaagaacccggaaatgacacaattgcgccaattgaaggagctgctggataacgctttgaatgtagctcattttgccaagttactgatgacgaagaccacgttggacaaccaagatggcaatttctatggagaatttggtgttttatatgatgagttggcaaaaatccccacactgtacaataaggtccgcgattatttgtcacagaaacccttttctactgagaaatacaaactgaatttcggaaatccgacattactgaacggctgggacctgaataaggaaaaagacaatttcggcgtcattctgcagaaagatggctgctactaccttgcacttctggacaaagcacacaaaaaggtgtttgataacgcacccaatacaggtaagaatgtataccaaaaaatgatttacaagcttttacccggacctaacaaaatgttaccccgtgtctttttcgctaaatcaaatctggattattacaaccccagcgcggagcttcttgacaagtatgcacaaggtacgcataagaagggggataattttaacttaaaagattgccacgctctgatcgattttttcaaagcgggcattaacaaacatcctgagtggcaaaatttcggtttcaagttcagccctacctcttcatatcgcgatctttccgatttttaccgtgaagttgaaccgcagggctatcaggttaagtttgttgatatcaacgctgactatattgatgagttggtggagcaagggcaattatacttatttcagatctacaataaggatttttcaccaaaagctcacggtaaaccgaatcttcacacactgtacttccgcgcgttatttagcgaggataatcttgctaatccaatttataaactgaatggtgaagctcagatcttttaccgtaaggcaagccttggaatgaacgaaacgactatccatcgcgccggagaaattttggaaaataagaacccagacaatcccaaagagcgcgtctttacctacgatatcatcaaagaccgccgctacacgcaagacaaattcatgctgcacgtccctattaccatgaactttggcgttcagggaatgactattaaggaattcaataaaaaggtaaatcagtcaatccgccagtacgacgatgtaaatgttatcggtattgatcgcggggagcgccaccttttgtaccttaccgtgatcaattctaaaggcgaaattcttgaacaacgctcactgaacgatattaccacagcttctgcaaatggcactcaaatgacgacaccctaccacaaaattctggacaaacgcgagatcgaacgtttaaacgcccgtgttgggtggggagagattgagaccattaaggaattgaaatcaggatacctgagccatgtagtgcatcaagtatcccagttaatgttgaagtataatgcaatcgttgtcttagaagatctgaactttgggttcaaacgtggccgcttcaaagtagaaaagcaaatctatcaaaacttcgaaaatgcgttgatcaaaaagcttaaccacctggaattgaaggataaggcggatgatgagattgggagctacaaaaatgctcttcaacttacgaataacttcacagatctgaaaaacattggaaagcaaactgggtttctgttctatgtgcccgcgtggaatacgtctaagatcgatccagagacagggtttgtcgatctgctgaagccgcgctacgagaacatcgcccaaagtcaagctttcttcggaaagtttgataaaatctgctataacgcagataaggactacttcgaattccacattgattatgcgaagtttacggataaggctaagaactctcgtcaaacttggaccatttgctcccatggagataagcgttacgtatatgataagactgcaaaccaaaataagggtgcgacaaaggggatcaacgtcaatgacgaattaaaatctttgttcgcacgttaccatatcaacgaaaagcaaccgaatctggtgatggacatctgtcaaaataacgacaaggaatttcataagtccttgatgtacctgttaaaaactctgttagcgttacgctattctaatgcctcttcagatgaagattttatcttatcaccggtcgccaacgacgaaggcgtctttttcaattccgctctggcggatgacacgcaacctcagaatgccgacgcgaacggggcgtatcacatcgccctgaagggtttgtggctgcttaatgaattgaagaactcggatgacttaaacaaagtcaagctggctatcgataaccaaacatggttaaattttgcacaaaaccgttaa

SEQ ID NO: 869 - DNA, 3756 bp, synthetic construct
  misc_feature 1..3756: note = Description of Artificial Sequence: Synthetic polynucleotide
  source 1..3756: mol_type = other DNA
atgctttttcaggactttacacacttgtacccactttccaagaccgtacgtttcgaactgaaaccaatcggccgcacactggagcacatccacgcaaaaaacttcctttctcaagacgagacaatggcggatatgtatcaaaaagttaaggtaattcttgacgactaccaccgcgatttcatcgcggacatgatgggggaggttaagctgacgaagttagcagaattctacgacgtataccttaagttccgcaaaaacccaaaggacgacgaattacaaaagcaacttaaggacttacaggcagttttacgcaaagagagcgttaaaccgattggtaacggtggcaaatataaggcaggacatgatcgtctttttggggcgaagctgttcaaggacggtaaggaattaggtgatcttgcgaaatttgttatcgcacaagaaggtaagtcatcaccgaagttggcgcatcttgcacattttgagaaattttctacgtatttcactgggttccacgataatcgtaaaaatatgtactcagatgaggacaagcacaccgccattgcatatcgcttaatccatgaaaaccttccgcgtttcattgacaacttacaaatcttaactacgatcaaacagaaacattccgctctgtatgaccaaatcattaacgaacttaccgctagcggtttagatgtctcactggcgtcacatctggatgggtaccacaagctgcttacacaggagggcatcaccgcctataatcgtatcattggcgaggtcaatggttatacaaacaagcacaaccaaatctgtcacaaatccgagcgtattgccaaactgcgcccgcttcacaaacaaattttatcagatgggatgggagtttcctttttgccctccaaattcgcggacgatagcgaaatgtgccaggcagttaacgagttctaccgtcattacgcagatgtttttgctaaggtccagtcgctttttgatggttttgatgatcatcaaaaagatggaatttacgtagaacacaagaatttaaacgagctgtccaagcaggcattcggtgattttgctttgcttggccgcgtattagacgggtattatgtcgatgtagtgaacccagaatttaacgagcgtttcgccaaagctaaaacggataatgcgaaggcaaaattgacaaaagagaaggataaattcatcaaaggagtgcacagccttgcgtccttggaacaggccatcaagcaccatacggcccgtcacgatgatgagtccgttcaggcgggcaaattggggcaatactttaagcacgggttagccggagtggacaatccaattcaaaagattcacaacaaccattcaacaatcaagggctttttagagcgtgagcgtcccgccggagagcgtgcactgcctaagattaaatccggcaagaatcctgagatgacacagttgcgccaactgaaggaactgttagacaacgctctgaacgtagctcatttcgcgaagttgttgatgacgaagaccaccttggataaccaagacgggaatttttatggtgagttcggggttttgtacgacgagctggccaagattcccactttgtacaataaagtacgcgattacctttcccaaaagccgttcagtacagaaaagtacaaacttaactttggtaatcccacgttgcttaatggctgggatcttaacaaagagaaagacaattttggagtcatccttcaaaaggacggctgctactatttggcattgttagataaggcacataaaaaagtgtttgacaacgcacctaacacggggaaaaacgtataccagaagatgatctataaattattacctggcccgaataagatgctgccccgcgtcttcttcgcgaagagtaacttagattattacaatcctagtgctgagttgttggataagtacgcgcaaggaacccacaagaagggagacaactttaacttgaaggactgccacgcactgattgattttttcaaggcaggcattaacaagcatcctgagtggcagaatttcggcttcaagttcagtccaacgtcgagctatcgtgacttatctgacttttatcgcgaggtagaaccccaaggatatcaggtaaaattcgtagatattaacgcggactacatcgacgagttagtggaacaaggccagttatacctgtttcagatttacaataaggatttttcacctaaagcgcacgggaaaccgaaccttcacaccctttattttcgtgctttattctctgaagataaccttgcaaatccgatttacaagttaaacggagaggcccagatcttctaccgcaaggcaagcttaggaatgaacgaaacaactatccatcgcgcaggtgaaatcctggagaacaagaaccctgacaacccaaaggaacgtgtgtttacgtacgacatcattaaagatcgccgttatacccaagacaagtttatgctgcatgttcctattacaatgaacttcggcgttcaaggcatgaccattaaggagttcaacaaaaaggtaaatcaatctatccgtcaatacgacgacgtgaacgtcatcggaatcgaccgcggagaacgtcatcttctgtatcttacggtcatcaacagcaagggggaaatcttggagcaacgcagtcttaacgacatcacaacagcatcagctaatggcacccaaatgacaactccctaccataagattcttgacaaacgtgaaattgaacgccttaatgctcgtgtaggttggggagaaattgaaacgatcaaggagctgaagtccgggtatctttctcatgtggtccatcaagtatcacaattgatgctgaaatacaatgcgattgtagtcttggaagacttaaacttcggtttcaagcgcgggcgctttaaagtggaaaagcaaatttaccaaaattttgaaaatgcactgatcaaaaagcttaatcatctggagcttaaagacaaagcggacgacgaaattggcagctataaaaacgcactgcaactgacgaacaatttcacggatttaaaaaatatcgggaaacagacgggtttcttattttacgtcccggcttggaatacaagcaagattgatcctgaaacaggtttcgtcgacttgcttaagcctcgttacgagaacattgcgcaatctcaagcattcttcggtaaattcgataagatttgctataatgctgataaggattacttcgagttccacatcgactatgccaagttcaccgacaaagcaaaaaatagtcgtcaaacatggacgatctgctcgcatggggacaagcgttatgtttacgataagaccgcgaaccaaaacaaaggggcgacgaaaggcattaacgtaaatgatgagcttaaatcattattcgcccgctaccacatcaatgaaaaacaacccaacctggtgatggatatctgtcaaaataacgataaggaatttcacaagagtttaatgtacttacttaaaacgttgctggcgttacgctactcgaacgcttcgtccgatgaggatttcattctgtctccagtggccaatgacgaaggcgtgtttttcaatagcgcactggctgacgatacgcaaccgcagaatgctgatgcgaacggtgcctaccatatcgccttaaaaggcctgtggctgctgaatgaattaaagaattcggacgaccttaacaaagtaaagttagctatcgacaaccagacttggcttaattttgctcagaaccgttaa

SEQ ID NO: 870 - DNA, 3756 bp, Moraxella lacunata
  source 1..3756: mol_type = genomic DNA
atgttatttcaagactttactcatttataccccctatcaaaaaccgtgcgttttgaattaaagcccattggtaagacattagaacatatccacgccaaaaactttttgagccaagatgagaccatggcggacatgtaccaaaaggtaaaggcgatactggacgattatcatcgtgattttatcaccaagatgatgagcgaggtgacattaactaaactgccagagttttatgaggtttatttggcattacgaaaaaatcccaaagatgacacattgcaaaaacagctaaccgagatacaaaccgctttacgagaagaggtagtcaagccgatagacagtggtggcaaatacaaggctggttatgaacgcttatttggggcaaagctctttaaagacggcaaagagcttggtgatttggcaaaatttgtcatcgcccaagagggcgagtcatcgcccaagcttccccaaattgcccattttgagaagtttagtacttactttacgggctttcatgataaccgcaaaaacatgtacagtagtgatgataagcataccgccattgcctatcgtctgattcatgaaaacttgccacgttttatcgataatctacaaatactggtaaccatcaaacaaaagcactcggtattgtatgaccagattgtaaatgagctaaatgccaacggtttggatgtgtcgctggcaagtcatctggacggctatcacaagcttttaacccaagagggtatcacggcttataataggataataggtgaagtgaatagttatacgaataagcataatcaaatttgccacaaatctgaacgtatcgccaaattacgccccctgcacaaacaaatcctaagcgacggcatgggcgtgtcatttttgccaagcaaatttgccgacgatagcgagatgtgccaagcggtcaatgaattttaccgccattatgcccatgtttttgccaaggtgcaaagcttatttgatagatttgatgactatcaaaaggacggcatttatgttgagcataaaaatttaaatgagctatctaagcaggcatttggcgattttgctttgttgggtcgggtgttagacggctattatgtggatgtggtgaatccagaatttaacgataaatttgccaaagccaaaaccgacaatgccaaagaaaaactgacaaaagaaaaagacaaattcatcaaaggcgtgcattccttggcaagtcttgaacaggcgatagagcattatattgctgggcatgatgatgagtctgtgcaggcgggcaagcttgggcagtatttcaaacatggcttggcgggggtggacaatccaatccaaaaaatacacaacagccacagcaccattaaggggtttttggagcgtgaacgcccagcaggcgagcgaacattgcccaaaatcaaatcagataaaagtcttgaaatgacacagttaagacaactaaaagaactgctagacaacgccctaaatgtggtgcattttgctaagttattaacgaccaaaaccacgctagataaccaagacggcaatttttatggtgagtttggggcattgtatgatgagcttgccaagattgccacgctttataacaaagtgcgtgattatctgtcccaaaagccatttagcaccgaaaaatacaaattaaactttggcaacccgacattattaaacggttgggatttgaataaagaaaaagataattttggggttatcttgcaaaaagacggttgttattatttggcgttattggataaagctcataaaaaagtatttgataatgctccaaatacaggcaaaagtgtttatcaaaaaatggtttataaattattgcctggccctaataaaatgctacccaaagtgttttttgccaagagtaatttggattattataatccttctgcagagctactggataaatatgcacaaggcacgcacaaaaaaggcgataattttaatctaaaagattgtcatgcgttgattgatttttttaaggcgagtattaacaaacatccagaatggcaacattttggttttgaattttcgctaaccagtagctatcaggatttaagtgatttttatagagaagttgaaccacaaggttatcaagtaaaatttgtggatattgatgccgattatattgatgagttggttgagcagggtcagttgtatttattccagatttataataaagatttctcgcccaaggctcatggtaaacctaatttacatactttgtattttaaggcgttatttagtgaggataatcttgccaatccaatttataaattaaatggcgaggcggagatattttatcgcaaggcatctttggatatgaatgaaaccaccattcatcgtgcaggcgaggtattagaaaataaaaatcccgataatcccaaagagcgtcaatttgtctatgacatcatcaaagacaaacgttatacccaagataagtttatgctacacgtgcctattaccatgaattttggtgtgcagggcatgacgattaaagaatttaataaaaaagttaatcaaagcatacaacaatatgatgaggtgaatgtgattggcatagaccgtggcgagcgacatctgctatatctgaccgtgattaacagcaaaggtgaaatcttagaacagcgtagtctcaatgacatcatcaccacatcggcaaacggcacacaaatgaccacgccttatcataagatactggacaaaagggagatagaacgcctaaatgctcgtgtcggttggggtgaaattgagaccattaaagagctaaaatcgggctatctaagccatgtggtacatcaaatcagtcagcttatgcttaaatataacgccattgtggtgttggaagatttgaattttgggtttaagcgtggtcgctttaaggtggaaaaacaaatttaccaaaactttgaaaacgccctaatcaaaaaactcaaccatttggtattaaaagacaaggcagataatgagattggctcatacaaaaatgccttgcaactgaccaataattttaccgacctaaaaagcattggcaagcaaacaggctttttattctatgtgcctgcatggaataccagtaaaatagaccctgtaacgggctttgtggatttgttaaaaccacgttatgaaaatatcgctcaatcgcaagcgttttttgataagtttgataagatttgttataacgcagacaagggttattttgaatttcatattgattatgccaaattcactgacaaagccaaaaattctcgccaaatatggacgatttgttcgcatggcgataaacgctatgtgtatgacaaaaccgccaaccaaaataaaggggcgaccattggcattaatgtcaatgatgaattaaaatcgttatttgctcgttatcgcatcaatgacaaacagccaaatctggtcatggatatttgccaaaataacgataaagaatttcataaatcgctaacgtatctgttaaaggcattgcttgcattacgatatagtaatgccagtagtgatgaagattttattttatcgcctgtggcaaatgacaagggtgtgttttttaattcggcgttggcagatgatacacagccacaaaatgcggacgccaatggtgcgtaccatatcgcattaaaggggctgtggctattaaacgaattaaaaaacagcgatgatttggataaagtcaaacttgccattgataatcaaacatggctaaacttcgctcaaaaccgctaa

SEQ ID NO: 871 - DNA, 3756 bp, synthetic construct
  misc_feature 1..3756: note = Description of Artificial Sequence: Synthetic polynucleotide
  source 1..3756: mol_type = other DNA
atgttgttccaggacttcactcatctttacccattatcaaaaacggtgcgctttgaactgaagcctattggtaaaacacttgaacacattcacgcaaagaattttctttctcaagacgaaaccatggctgatatgtatcagaaggtaaaggccatcttagatgattaccatcgcgatttcatcacgaaaatgatgagcgaggttaccttgaccaagttacccgaattttatgaggtgtaccttgccttgcgcaagaaccctaaagacgatactttacagaaacagcttacggaaattcagactgcattgcgcgaggaggtggttaaaccgatcgatagcggagggaagtacaaggccggttacgaacgtcttttcggggcgaaattatttaaggatggaaaagaactgggagatttggcaaaattcgtgattgcacaggaaggggaatccagcccaaagctgcctcagatcgctcatttcgagaagttctctacgtatttcacaggattccacgacaaccgtaaaaatatgtattcgagtgatgataagcacacggccattgcctaccgtttaatccacgagaatttaccccgctttattgacaatttacaaatcttggtgacgattaagcaaaaacactctgttttgtatgatcagatcgtaaacgaattgaacgcgaatggtttggacgtaagcttagcgagccaccttgatggataccataaattattaacacaagaaggcattacggcctacaatcgcattattggagaggttaattcctacactaacaagcacaatcagatctgtcacaaatctgagcgtatcgctaagcttcgccccttgcacaaacagattttaagcgacgggatgggcgtctctttcttaccttccaagtttgctgacgattctgagatgtgtcaggcagttaacgagttctaccgccattacgcccatgtctttgctaaggtacagagtttattcgaccgcttcgatgattaccaaaaggatggcatctacgtggaacacaaaaacttaaacgagttgtctaaacaagcatttggagattttgccttactggggcgcgttctggacggttactatgttgatgtcgtcaatcctgaatttaacgataaattcgcgaaggcgaaaacagacaacgcgaaggaaaagctgacaaaggaaaaagataagtttattaagggtgttcactcccttgcgtcgttggagcaagcaatcgaacactatatcgcgggccatgacgacgaatccgtgcaagctggcaaattaggccaatattttaaacacggcttggcgggcgttgataaccctatccagaaaattcacaatagccactcaaccattaagggcttcttagaacgtgaacgtcctgccggcgagcgtaccctgccgaaaattaagtctgataaatccttagagatgacgcagttacgccagctgaaggagttgcttgacaacgctctgaacgttgtgcactttgcaaaattacttactactaagactacgcttgataaccaggatggaaatttctatggcgaatttggagctttatatgatgaattagcaaaaattgcgaccctgtataacaaagttcgtgattacttgagtcaaaaaccattttctaccgagaagtacaaattgaactttggaaatccaacgttattaaatgggtgggatctgaacaaagagaaggataatttcggagttattcttcagaaggatggatgctattacctggcgttacttgataaggcgcacaaaaaggtgttcgacaacgctcctaacactggaaaatcggtttatcagaagatggtctacaagttacttccgggaccgaataaaatgctgccgaaagttttttttgcaaagtctaaccttgactattacaatccatccgcagagcttttagataaatacgcccagggcacccacaaaaagggtgacaattttaatttaaaggactgccacgcacttatcgactttttcaaggcttcaatcaacaagcatccagagtggcagcactttggcttcgagttctctttgacatcttcgtatcaggatctttctgatttctatcgtgaagttgaaccacagggttatcaggttaaattcgttgacattgacgccgactacatcgatgagctggtggagcagggtcagttatacctgttccaaatctataataaagatttcagtccgaaagcacatggtaagcccaatcttcatacgctttatttcaaggctctgttttcagaagacaaccttgcaaacccaatttacaaattgaacggtgaagcggagattttttaccgtaaagccagtttagatatgaacgaaaccacaattcaccgcgcaggtgaagtgttagagaataagaatcctgataacccgaaggaacgccagttcgtctatgacattatcaaagacaagcgctatacccaggacaaatttatgttgcacgtgccaatcaccatgaatttcggcgtgcaggggatgactattaaagaattcaacaagaaggtcaaccagagtatccaacaatatgacgaagtgaacgttattggcattgatcgcggcgagcgccaccttttgtacctgacggtaattaattcgaagggagaaattctggaacaacgttctctgaacgatatcattacaacatcggcgaatgggacgcagatgacgaccccttaccacaagattcttgataaacgtgaaattgaacgccttaacgcccgtgttggatggggtgagattgaaaccattaaggaattgaaaagtgggtacctgtcccatgttgtacaccagatcagccaattgatgttgaaatataacgcaattgtagtgttagaggatttaaacttcgggtttaagcgtgggcgtttcaaggtagaaaagcaaatttaccagaactttgagaatgctttaattaagaaacttaatcacttggttttgaaggacaaggccgacaacgagatcgggtcctacaaaaacgcgttgcaattaaccaataactttacggacttgaaaagtattgggaagcagaccggctttttattctacgtgccagcttggaacacatccaagattgatccggttacgggttttgtagacctgttaaaacctcgctatgaaaatattgctcaatcccaagctttcttcgacaagttcgataaaatctgctacaatgcagataaagggtattttgagtttcatatcgattatgccaaattcacagataaagctaaaaatagtcgccaaatctggacaatctgtagtcatggggacaagcgttacgtatacgacaagactgcaaaccagaataaaggtgccacaattgggatcaacgtgaatgacgagcttaaatccttatttgcacgttaccgcatcaatgataagcaaccaaatctggtcatggatatttgtcaaaacaacgacaaagagttccataaatctttgacctacttgcttaaagccctgttggccttgcgctatagcaacgcgtcaagcgatgaggatttcatccttagtccagtggccaacgataagggagtctttttcaatagcgctcttgctgatgatactcaacctcagaatgccgacgcgaacggagcgtaccatattgcacttaaaggcctgtggcttttgaatgaattgaaaaactcagatgatctggataaggtaaaattggcaattgacaatcaaacatggctgaactttgctcaaaaccgctaa

SEQ ID NO: 872 - DNA, 3756 bp, synthetic construct
  misc_feature 1..3756: note = Description of Artificial Sequence: Synthetic polynucleotide
  source 1..3756: mol_type = other DNA
atgcttttccaagattttactcatttatacccgttaagcaaaacggtacgtttcgaacttaaacctatcgggaaaacgcttgaacacatccatgccaagaacttcctgagtcaggatgaaacgatggcggacatgtaccaaaaggtaaaggccattttagatgactatcatcgtgattttattaccaagatgatgtctgaggtaactttaacgaaattaccggaattttatgaggtctatcttgccttacgtaaaaacccgaaagatgacacattgcaaaaacagttaacggagatccaaaccgctctgcgtgaagaagtcgtgaagcccattgattcgggaggtaagtacaaggcgggatacgaacgccttttcggagccaaactgtttaaggacgggaaagaacttggcgacttggccaaattcgttatcgcacaagaaggcgaaagctctccaaaattaccccaaattgcccatttcgagaaatttagtacctactttacgggttttcacgacaaccgtaaaaatatgtacagctctgatgataaacacacggcgattgcatatcgtttgatccacgagaatcttccccgtttcattgacaaccttcaaattctggtgacaattaaacaaaagcattcggtcttatatgatcagatcgttaatgaattaaatgctaatggacttgatgtatcgttagctagccatttagatggttatcataaattgcttacgcaggagggaattactgcatacaatcgtatcattggggaagtgaatagttacaccaataaacataaccagatttgtcacaaaagtgagcgtattgcgaaactgcgtccgcttcataaacaaattttgagtgatggcatgggggtgtctttcttaccgagtaagtttgctgatgacagtgagatgtgccaagctgtcaacgagttttaccgtcactatgctcatgtgtttgcaaaagtacagtcccttttcgatcgcttcgatgactatcaaaaggatgggatctacgtggaacacaagaacttgaatgagttaagcaaacaggccttcggagattttgcactgttggggcgcgttttagacggatactatgtagacgttgttaaccctgagtttaatgataagttcgcgaaagcaaaaacggacaacgccaaagaaaaattgactaaggaaaaggacaaatttattaagggagtacattctcttgcgtccttggaacaagcgatcgaacattacatcgcgggccatgatgacgagagtgtccaagctggtaaacttggacagtattttaaacacggtctggccggtgttgataatccgatccagaaaattcataattcgcactcgaccattaaaggatttcttgaacgtgagcgtcccgctggcgagcgcaccttgcctaagatcaagtctgataagtctcttgaaatgactcaattgcgtcaactgaaagaacttctggacaacgcgttgaacgtcgtacatttcgccaagctgttgaccacgaagactacgcttgataatcaggacgggaacttctatggcgagttcggagctctgtacgatgagttggcgaaaatcgcgactttatataataaagttcgtgattatttgtcccaaaagccgtttagtacggaaaagtacaagctgaatttcggcaatcccactcttctgaacggctgggatttaaacaaagaaaaagacaacttcggggttatcttacaaaaggatggctgctattacctggcattacttgataaggcacataaaaaagtatttgacaacgcaccaaacaccggcaaaagcgtgtaccagaaaatggtatataaattgcttcccggtcctaacaagatgttaccgaaggttttttttgcaaaatccaatctggactattacaatccgagcgcagagcttctggacaagtacgcccagggtacgcataaaaaaggcgataatttcaacttgaaggactgtcatgcgctgatcgacttttttaaggctagtattaataaacaccccgagtggcaacattttgggtttgaattcagtctgacaagttcttaccaagacttgtcggacttttatcgtgaagtagagccacaaggttaccaagtaaaattcgtggacatcgatgctgactacatcgatgaacttgtcgagcaggggcagttgtatctttttcaaatttataataaagattttagtcccaaagcgcatggaaagccaaacttgcatacattgtactttaaagcattattttcggaagacaacctggccaatcctatctacaaattaaacggagaagcggaaattttttaccgcaaggcatctttggacatgaacgaaacaacgatccatcgtgctggggaggtccttgagaacaaaaaccccgacaaccccaaagaacgtcaattcgtttacgatatcatcaaagacaagcgttatacccaagataagtttatgttgcatgttccaattacgatgaattttggggtacaggggatgacaatcaaggaatttaacaagaaagtgaatcaatcaatccaacagtatgatgaagtgaacgtcattggtattgaccgcggagaacgccatctgttataccttactgtcattaactcaaagggagaaattttagagcaacgtagcttgaacgatatcattacgacgtccgcgaacggaacccaaatgaccacaccatatcacaagattttagataaacgtgagatcgaacgtcttaatgctcgcgtcgggtggggagagattgaaacgatcaaagagttaaaatctggatatttatctcatgttgtacaccagatcagccaattgatgttaaaatataatgctatcgtggttctggaagatctgaactttgggtttaagcgtggacgttttaaggttgaaaaacaaatctaccaaaacttcgagaatgcactgattaaaaagttgaaccacttagtgttaaaggataaggccgacaacgaaattggctcttacaagaatgcgcttcagctgacgaataatttcaccgatttgaaatcaatcggcaaacagaccggattcctgttctacgtcccggcttggaacacgtccaagatcgatcctgtgactggttttgttgacttattgaaaccccgctatgaaaacatcgcgcaatctcaagcgttctttgataagttcgataaaatctgctataatgcagacaaaggatatttcgagttccatattgattatgcaaaatttactgataaagcgaagaacagccgccagatctggacaatttgctcacacggtgataaacgttatgtttacgacaaaaccgctaatcaaaataaaggagccacaatcggcattaacgttaacgacgagttgaagtccctttttgcacgttatcgcattaacgacaaacagccaaatcttgtcatggatatttgtcaaaataatgacaaagaatttcataagagccttacgtaccttttgaaagctttattagcattacgctatagtaatgcctcatctgatgaggatttcattcttagcccggttgctaacgataaaggggtttttttcaatagtgctctggcagacgacacacaacctcaaaacgctgatgctaatggagcttatcacattgcgttgaagggactttggctgttaaatgaattgaaaaattctgacgacttggataaggtgaagttagcaattgacaaccaaacgtggttaaactttgcgcagaatcgttaa

SEQ ID NO: 873 - DNA, 3756 bp, synthetic construct
  misc_feature 1..3756: note = Description of Artificial Sequence: Synthetic polynucleotide
  source 1..3756: mol_type = other DNA
atgctttttcaggatttcactcatttatacccattgagtaaaacagtccgtttcgagttgaaacccattggtaaaactcttgagcacattcacgctaagaatttcttatctcaagacgagaccatggccgatatgtaccaaaaagtaaaggctatcttagacgactatcaccgcgactttatcacaaagatgatgtctgaggtaactttgacaaagttacccgaattttacgaagtgtatcttgccctgcgtaaaaacccaaaagatgatactttgcaaaaacagttaacagaaatccaaaccgcattgcgcgaagaagtggtcaaaccgatcgacagcggtggtaaatacaaagctggttatgagcgtttgtttggtgctaaactttttaaggatggcaaggaactgggagaccttgcgaagttcgtaattgcccaagaaggagagagtagtccaaaattgcctcaaatcgcgcacttcgaaaaattctcgacgtattttactggctttcacgacaaccgtaaaaacatgtactcgtcggacgataaacatacggctattgcatatcgtttaatccatgaaaatttgccgcgtttcatcgataatttacaaatccttgttactattaaacaaaagcacagtgtactgtacgaccaaattgtgaatgaattaaatgcgaatggtcttgacgtttcgttagcctcccaccttgatggttaccacaagttgctgacccaggagggtattacagcatataatcgcatcattggtgaggtaaattcgtatactaacaagcacaatcaaatctgccataaatcagaacgtattgccaaattacgccctctgcataaacagatcttaagcgatggtatgggcgtcagttttttgccgtcgaaatttgcagatgacagcgagatgtgtcaagcggttaacgaattctaccgccactacgcccatgtatttgcaaaagtgcaaagccttttcgaccgctttgatgattaccaaaaagatggcatttacgtagagcacaaaaacttaaatgagttatcaaagcaagcttttggtgattttgcattgttgggtcgcgtccttgatggctattacgtggacgtcgtcaatcctgagtttaatgataagtttgcaaaagcaaagactgacaacgcaaaggaaaaacttactaaggagaaggataagtttattaaaggggtacattctttagcatcattggaacaggcgatcgaacattatatcgcgggtcatgacgatgagagtgtccaagctggcaagctggggcaatacttcaagcacggcctggctggcgtagacaacccaattcagaaaattcacaacagccatagtactattaaaggctttttggaacgtgagcgtcctgcgggagaacgcacattaccgaagattaaatcagataaatcattggagatgactcagttacgccaactgaaagaattgttggacaatgcattgaacgtggtccattttgcgaaattattaacgactaagacgacgctggacaatcaagatggtaatttttatggtgaatttggagcactgtacgatgagttggccaaaattgcaacactgtataataaagtacgcgactacttgtcccagaagcccttttcaacggagaagtacaaactgaactttggtaaccctaccttgttaaacggctgggatttgaataaggagaaggacaatttcggtgtcatcctgcagaaagatggatgctactatctggcgcttctggacaaagctcataaaaaggtcttcgacaatgctccgaatactggaaagtcggtgtaccaaaaaatggtttacaaacttctgcccggtcccaataagatgttgcccaaggtatttttcgctaagtccaatttggattactacaatccctctgcggaattattagacaaatacgctcagggcacacacaaaaagggggacaacttcaatcttaaggattgccacgcattaatcgactttttcaaagcgtcgatcaataaacatccagagtggcaacactttggattcgaattcagcttgacgtcaagttaccaagacctttccgacttctatcgtgaagtcgaaccccaaggttaccaagttaagttcgtggatattgatgcggactacattgacgagctggtggaacaaggccagctttatttgttccaaatctacaataaagacttcagcccgaaagcgcatgggaagccaaatcttcacacattatactttaaggctcttttttcggaggacaacttggctaatcccatttataaattaaatggtgaggctgaaatcttctaccgcaaggccagtttggatatgaacgaaacgaccatccaccgtgccggggaggtattagaaaacaaaaacccggataacccgaaagagcgtcagttcgtttatgatatcatcaaagacaagcgttacactcaagataaattcatgctgcacgttcctattacgatgaactttggcgttcagggcatgactattaaagaattcaataagaaggtgaaccagtctattcaacagtacgacgaggtaaatgttatcggtatcgaccgcggggaacgccatcttttataccttaccgttattaattccaagggggaaatccttgagcaacgtagtcttaacgatatcattactacgtccgcgaatgggacgcaaatgacgacaccatatcataagatcctggacaagcgtgagatcgaacgtttaaatgctcgcgtgggttggggcgaaattgaaacgattaaagagctgaaaagcggttacctttcgcacgttgtgcatcaaatctcacaattaatgttaaaatacaatgctattgtcgttttagaggatcttaactttggtttcaagcgtggtcgttttaaagtagaaaagcaaatttatcaaaacttcgagaatgcgcttattaagaaattaaaccacctggtcctgaaggataaagcggacaatgagatcggcagttacaaaaacgcattgcagctgacgaataatttcacagatctgaaatcaattggaaagcagaccgggtttttgttttacgttccggcatggaacacctcgaaaattgaccccgtaacggggtttgttgatttgttaaagccccgctacgaaaatattgctcagtcacaagctttttttgacaaatttgacaaaatctgttacaacgctgacaaaggttatttcgaattccacatcgattatgcgaaatttacggataaagcgaaaaattcgcgtcagatctggacaatctgttcgcatggtgataagcgctatgtatatgacaaaacagcaaaccagaacaagggagctacaattgggattaatgttaacgacgagctgaagtcactttttgcgcgctaccgtattaacgataagcaaccgaaccttgttatggacatctgccaaaacaatgacaaagaattccacaagtcattgacgtacctgttgaaagctttactggcactgcgttattccaacgcttcctcggacgaagatttcattttgtcgcctgtagcgaatgacaaaggcgtgttctttaactctgctttggcagatgatacacaacctcaaaatgcggacgccaacggtgcctaccatatcgcgctgaagggtttgtggttattaaatgagcttaaaaacagtgatgatttggataaggtaaagttagccatcgataatcagacttggttgaattttgctcaaaaccgttaa

SEQ ID NO: 874 - DNA, 3756 bp, Moraxella lacunata
  source 1..3756: mol_type = genomic DNA
atgttatttcaagactttactcatttataccccctatcaaaaaccgtgcgttttgaattaaagcccattggtaagacattagaacatatccacgccaaaaactttttgagccaagatgagaccatggcggacatgtaccaaaaggtaaaggcgatactggacgattatcatcgtgattttatcaccaagatgatgagcgaggtgacattaactaaactgccagagttttatgaggtttatttggcattacgaaaaaatcccaaagatgacacattgcaaaaacagctaaccgagatacaaaccgctttacgagaagaggtagtcaagccgatagacagtggtggcaaatacaaggctggttatgaacgcttatttggggcaaagctctttaaagacggcaaagagcttggtgatttggcaaaatttgtcatcgcccaagagggcgagtcatcgcccaagcttccccaaattgcccattttgagaagtttagtacttactttacgggctttcatgataaccgcaaaaacatgtacagtagtgatgataagcataccgccattgcctatcgtctgattcatgaaaacttgccacgttttatcgataatctacaaatactggtaaccatcaaacaaaagcactcggtattgtatgaccagattgtaaatgagctaaatgccaacggtttggatgtgtcgctggcaagtcatctggacggctatcacaagcttttaacccaagagggtatcacggcttataataggataataggtgaagtgaatagttatacgaataagcataatcaaatttgccacaaatctgaacgtatcgccaaattacgccccctgcacaaacaaatcctaagcgacggcatgggcgtgtcatttttgccaagcaaatttgccgacgatagcgagatgtgccaagcggtcaatgaattttaccgccattatgcccatgtttttgccaaggtgcaaagcttatttgatagatttgatgactatcaaaaggacggcatttatgttgagcataaaaatttaaatgagctatctaagcaggcatttggcgattttgctttgttgggtcgggtgttagacggctattatgtggatgtggtgaatccagaatttaacgataaatttgccaaagccaaaaccgacaatgccaaagaaaaactgacaaaagaaaaagacaaattcatcaaaggcgtgcattccttggcaagtcttgaacaggcgatagagcattatattgctgggcatgatgatgagtctgtgcaggcgggcaagcttgggcagtatttcaaacatggcttggcgggggtggacaatccaatccaaaaaatacacaacagccacagcaccattaaggggtttttggagcgtgaacgcccagcaggcgagcgaacattgcccaaaatcaaatcagataaaagtcttgaaatgacacagttaagacaactaaaagaactgctagacaacgccctaaatgtggtgcattttgctaagttattaacgaccaaaaccacgctagataaccaagacggcaatttttatggtgagtttggggcattatatgatgagcttgccaagattgccacgctttataacaaagtgcgtgattatctgtcccaaaagccatttagcaccgaaaaatacaaattaaactttggcaacccgacattattaaacggttgggatttgaataaagaaaaagataattttggggttatcttgcaaaaagacggttgttattatttggcgttattggataaagctcataaaaaagtatttgataatgctccaaatacaggcaaaagtgtttatcaaaaaatggtttataaattattgcctggctctaataaaatgctacccaaagtgttttttgccaagagtaatttggattattataacccttctgcagagctactggataaatatgcacaaggcacgcacaaaaaaggcgataattttaatctaaaagattgtcatgcgttgattgatttttttaaggcgagtattaacaaacatccagaatggcaacattttggttttgaattttcgctaaccagtagctatcaggatttaagtgatttttatagagaagttgaaccacaaggttatcaagtaaaatttgtggatattgatgccgattatattgatgagttggttgagcagggtcagttgtatttattccagatttataataaagatttctcgcccaaggctcatggtaaacctaatttacatactttgtattttaaggcgttatttagtgaggataatcttgccaatccaatttataaattaaatggcgaggcggagatattttatcgcaaggcatctttggatatgaatgaaaccaccattcatcgtgcaggcgaggtattagaaaataaaaatcccgataatcccaaagagcgtcaatttgtctatgacatcatcaaagacaaacgttatacccaagataagtttatgctacacgtgcctattaccatgaattttggtgtgcagggtatgacgattaaagaatttaataaaaaagttaatcaaagcatacaacaatatgatgaggtgaatgtgattggcatagaccgtggcgagcgacatctgctatatctgaccgtgattaacagcaaaggtgaaatcttagaacagcgtagtctcaatgacatcatcaccacatcggcaaacggcacacaaatgaccacgccttatcataagatactggacaaaagggagatagaacgcctaaatgctcgtgtcggttggggtgaaattgagaccattaaagagctaaaatcgggctatctaagccatgtggtacatcaaatcagtcagcttatgcttaaatataacgccattgtggtgttggaagatttgaattttgggtttaagcgtggtcgctttaaggtggaaaaacaaatttaccaaaactttgaaaacgccctaatcaaaaaactcaaccatttggtattaaaagacaaggcagataatgagattggctcatacaaaaatgccttgcaactgaccaataattttaccgacctaaaaagcattggcaagcaaacaggctttttattctatgtgcctgcatggaataccagtaaaatagaccctgtaacgggctttgtggatttgttaaaaccacgttatgaaaatatcgctcaatcgcaagcgttttttgataagtttgataagatttgttataacgcagacaagggttattttgaatttcatattgattatgccaaattcactgacaaagccaaaaattctcgccaaatatggacgatttgttcgcatggcgataaacgctatgtgtatgacaaaaccgccaaccaaaataaaggggcgaccattggcattaatgtcaatgatgaattaaaatcgttatttgctcgttatcgcatcaatgacaaacagccaaatctggtcatggatatttgccaaaataacgataaagaatttcataaatcgctaacgtatctgttaaaggcattgcttgcattacgatatagtaatgccagtagtgatgaagattttattttatcgcctgtggcaaatgacaagggtgtgttttttaattcggcattggcagatgatacacagccacaaaatgcggacgccaatggtgcgtaccatatcgcattaaaggggctgtggctattaaacgaattaaaaaacagcgatgatttggataaagtcaaacttgccattgataatcaaacatggctaaacttcgctcaaaaccgctaa

SEQ ID NO: 875 - DNA, 3756 bp, synthetic construct
  misc_feature 1..3756: note = Description of Artificial Sequence: Synthetic polynucleotide
  source 1..3756: mol_type = other DNA
atgttattccaagatttcacacatctttatccactgtcgaagacagtccgctttgagttaaagcctattggaaagacccttgaacacattcatgcgaagaatttcttatcacaagacgaaacaatggcagatatgtatcaaaaagtgaaagctatcttagacgactatcatcgcgattttatcacgaagatgatgagtgaagtcaccttgaccaagttacctgagttttacgaggtttatctggccttacgcaagaatccaaaagacgacaccctgcaaaaacagttaaccgagattcaaacagccttacgtgaagaagttgtgaagcccattgattccggaggcaaatataaagcgggttacgagcgtttatttggggctaaactttttaaggacggaaaggaacttggcgacctggccaaatttgttattgcccaagaaggggaaagctcgccgaagcttccacagatcgctcattttgaaaaattttctacctacttcacgggttttcatgataaccgtaaaaacatgtatagctctgacgataagcacacagctatcgcttaccgccttattcacgagaaccttccgcgttttatcgacaatttgcaaatccttgtaaccatcaaacaaaaacactcagtcctgtatgaccaaattgtcaacgaacttaacgcgaatggcttggatgtttctctggcgtcccacttagatgggtaccacaagctgttgactcaggaaggcattacagcatataatcgtattatcggagaggttaattcgtacactaacaagcacaaccaaatctgtcacaaatctgaacgcatcgctaagctgcgtccattacacaagcaaatcctgtcggacggcatgggagtatcgttcctgccgtctaagttcgcggacgacagtgaaatgtgtcaagcagttaatgaattctatcgtcactacgctcacgtgttcgcgaaggttcaaagcttattcgaccgcttcgatgactatcaaaaggacggtatttatgtggagcacaaaaatctgaacgagctgtctaaacaggcgttcggcgattttgccctgctggggcgcgtattagacggttattatgtcgatgtagtcaatcctgagtttaacgataagtttgctaaggccaagaccgataacgcgaaagagaagttgacgaaagaaaaggacaaattcattaagggggtgcattctttggcttctttggagcaagcgattgagcattatatcgcgggccacgatgatgaatctgttcaggccggtaagctgggacagtacttcaaacatggactggcgggtgttgacaaccctattcaaaaaatccacaacagccacagcacaatcaaggggtttcttgaacgcgaacgtccagccggtgaacgtaccttacctaagatcaagtcggacaagagtttggagatgactcaattgcgtcagcttaaggagttgctggacaacgctctgaacgtcgtccatttcgcgaaattattaacaacgaagacgactttagataaccaggatggcaatttctatggagaattcggagctttgtatgacgaactggcaaaaatcgctacgctgtataataaagtgcgtgactatttgagccagaaaccctttagcactgaaaagtataaacttaacttcggaaatccgacactgttgaatggatgggatcttaacaaggaaaaggataattttggagtaatcttgcagaaagacggctgctattacttggctttgctggacaaagcccacaagaaggtatttgataatgcgccgaatacgggtaagagcgtctaccagaaaatggtatataagctgcttccgggcagcaacaaaatgttacccaaagtgtttttcgcaaagtccaaccttgattattataatccgagtgccgagctgttagacaaatatgcgcagggaactcacaagaaaggagacaatttcaatctgaaggactgtcatgccttaattgattttttcaaagctagcatcaataaacatcccgaatggcaacactttggtttcgagtttagcctgacttcgagttatcaagaccttagcgacttctatcgtgaagtggaacctcaagggtatcaagtcaaattcgtggacattgacgccgattatattgatgaactggttgagcaaggacagctttacctgttccagatctataataaggatttctcgccgaaggcacacggtaaacctaacttgcatactttgtactttaaagcgcttttcagtgaggacaatttagcaaacccaatctataagttaaatggcgaggcggaaattttctaccgtaaagcgtcattagacatgaatgaaacaacaatccatcgcgccggcgaagttttggagaacaagaaccctgataacccgaaagagcgccagttcgtttatgacattatcaaggataagcgctacactcaggataaatttatgttgcatgtacccatcacaatgaacttcggggtacagggaatgactatcaaggagtttaataaaaaagtcaatcagtcgatccagcagtatgatgaagtgaacgtaatcggaattgatcgcggagagcgccacttgctgtacctgaccgtaattaacagtaaaggagaaatcctggagcagcgcagcctgaatgacatcattacgacgagcgcgaatggaacccagatgacaacaccgtatcataagattctggacaagcgtgagatcgaacgtttaaacgctcgcgttggatggggggaaatcgagacaatcaaggagttgaaatccgggtaccttagccatgtggtacaccaaatctcgcaattaatgcttaaatacaacgctattgtagtgctggaagatctgaatttcggttttaaacgtggacgtttcaaggtcgaaaaacaaatttaccaaaatttcgaaaatgctcttattaaaaagcttaaccaccttgtccttaaagataaagcggataatgagattggctcatacaaaaatgccctgcagttgaccaacaacttcactgaccttaagagcattggaaaacagacagggtttcttttttacgtcccggcatggaacacgtcaaaaattgacccagtcacggggttcgtagacttactgaaaccacgctatgaaaatatcgcgcaaagtcaggcgttctttgataaatttgacaaaatctgctataatgctgataaaggttattttgagtttcatatcgactacgccaaattcacggataaggcgaagaatagccgccagatctggacgatttgcagccatggggataagcgttatgtatatgacaagacggccaatcagaataaaggcgccactattggcattaacgtcaacgacgagttaaagagcctttttgcacgctatcgtatcaacgataaacagccgaatctggttatggatatttgccagaacaatgataaagagtttcacaaatctcttacttacttattaaaagctcttttggctcttcgttactccaacgcatcctcggacgaagatttcatcctgtctccggtagctaacgataaaggcgtgttcttcaattccgctttagcggatgatactcagccgcagaacgcggatgcaaatggggcttatcacattgctttaaagggtttatggttattaaatgagttgaaaaactcagacgatcttgacaaagtaaagttggctattgacaatcaaacatggttaaactttgctcagaaccgctaa

SEQ ID NO: 876 - DNA, 3756 bp, synthetic construct
  misc_feature 1..3756: note = Description of Artificial Sequence: Synthetic polynucleotide
  source 1..3756: mol_type = other DNA
atgctgttccaagactttactcacctttatccgctttctaaaaccgttcgcttcgaacttaaacctattggtaagacactggagcatatccacgccaaaaacttccttagccaggacgaaacaatggcagacatgtaccaaaaggtaaaggcaattttggatgattatcaccgcgatttcatcacaaagatgatgtctgaggtcacattaaccaaactgcccgaattttacgaggtgtacctggcccttcgcaaaaaccccaaggacgatacccttcaaaagcaacttacggagatccagacggcgctgcgcgaggaagtggtcaaaccgatcgactcggggggaaagtacaaggcgggttacgagcgtttgtttggtgcaaaattatttaaggatggcaaggaactgggtgacttagcaaaatttgtcatcgcccaggagggcgaaagctcccccaaattacctcagattgcccattttgagaagtttagcacctatttcacgggttttcatgataaccgcaaaaatatgtatagcagcgacgataagcatacggcgatcgcatatcgtcttatccatgaaaatttaccgcgtttcattgacaacttgcaaatcttagtcaccattaagcaaaaacatagcgtcttatacgaccaaattgtcaacgagttgaatgccaatgggttagacgtctccttagcgagtcaccttgatggataccataagttacttacccaagagggtatcactgcatataatcgtatcattggtgaagttaattcatacactaacaaacataatcagatctgccataagtcggagcgtatcgcaaaattacgcccattacataagcagattctgtccgacggcatgggggtctcctttcttccgtcgaagtttgctgacgacagtgaaatgtgccaggctgtcaatgaattctatcgccattatgctcatgtattcgctaaggttcaatcactgtttgatcgtttcgatgattatcagaaagatggaatctatgtggaacataagaacctgaacgaactttcaaaacaggcgttcggcgatttcgcacttcttggacgtgtccttgatggttactatgtggatgtcgtcaacccagagttcaatgacaaattcgcgaaggccaagacggataacgcaaaagaaaaacttacaaaggagaaagataaattcatcaaaggcgtgcactcccttgcgtcgctggaacaggcgattgaacactatattgcaggacatgatgatgagagcgtacaagcaggaaaattaggacaatattttaaacacggtttggcgggagtagataatccgatccaaaagatccacaatagccacagtactatcaaaggttttcttgaacgcgagcgccccgcaggagaacgtaccctgccaaagatcaagagcgataagtctttagaaatgacccaattacgccagctgaaagagttgttagataatgcattaaacgtagtacactttgctaagttgttgaccacgaagactacgttggacaatcaagacggtaacttctacggtgaattcggagctttatacgatgagcttgcaaagattgcaaccctgtataataaggtgcgcgactatttgtcccagaagcccttttccacggaaaaatataaactgaactttgggaacccgacattacttaatggatgggatttaaataaggaaaaagacaacttcggtgtgatcttgcaaaaggacggctgttattacctggccctgttggataaagcacataaaaaagtgttcgataatgcccctaatacggggaagtcagtctaccaaaaaatggtgtataaattattacctgggtccaacaagatgcttcctaaagtattctttgcgaaatcaaaccttgattattacaatccctcggcggagcttctggataagtacgcgcaaggcacacacaagaagggggacaacttcaacttaaaggactgtcatgcacttattgatttcttcaaagcttcaattaataaacacccggagtggcaacactttgggtttgaattctctcttacttcatcctaccaggatttgtccgatttttatcgtgaagttgagccacagggttatcaagttaagttcgttgacatcgatgccgactatatcgatgaattagttgaacaaggccaactgtatttatttcaaatttacaacaaagattttagcccaaaagctcacgggaagccaaatttgcataccttatatttcaaggcccttttcagtgaagataatctggcaaatcctatttataagttgaatggtgaggcggagatcttttaccgtaaggcttcgctggatatgaacgaaacaacgattcatcgtgcaggcgaagtgctggaaaataaaaacccagataacccgaaggagcgccagtttgtatacgatatcattaaggataaacgttacacgcaggacaaatttatgttgcatgtgccaatcaccatgaactttggtgtgcaggggatgacgatcaaggaattcaacaaaaaggtcaaccaaagcatccaacagtacgacgaggtaaatgtgattggtattgatcgtggagagcgccatttgttatatttaacggtcatcaactctaagggggagatcttggagcaacgctcactgaatgatattattacaacgagcgccaacggcactcaaatgacaactccataccacaaaatcttggataaacgcgagattgaacgtttgaacgcacgtgttggatggggagaaattgaaaccattaaagaattaaaatcgggttatcttagccatgtcgtacaccaaatttcccagttaatgctgaagtacaatgcaattgttgtcctggaagatttaaattttggatttaagcgcggccgtttcaaagtcgaaaaacaaatctaccagaacttcgaaaatgccctgatcaaaaaattgaaccaccttgtacttaaggacaaggcagataacgaaatcggcagttataagaatgcccttcaactgacaaataattttaccgacttaaaaagcattggtaaacaaacagggtttttgttctatgtacctgcatggaatacctccaaaattgatccagtaactgggttcgtagatctgttgaagcctcgttatgaaaacattgcccagtctcaggcatttttcgacaagttcgataagatctgctataacgcggataaaggttactttgaattccacattgattatgcaaaatttacggacaaggctaagaattctcgccagatttggaccatctgttcacatggtgataaacgttacgtctacgataagaccgctaatcaaaacaagggggcaacaatcggcattaacgttaatgatgagctgaaatctttatttgcccgctaccgtatcaatgacaaacaaccgaaccttgtcatggatatctgccaaaacaatgataaggaatttcacaaatcgctgacctatttattgaaggcgttgttagctttacgttattctaatgcgtccagtgacgaggactttattctgtctccagtcgctaacgataaaggggtctttttcaactcagctcttgccgatgatactcaaccacaaaatgctgacgcaaacggggcctatcatatcgcgctgaagggcctttggctgttaaacgaattaaagaacagtgacgatttggataaagtcaagttagcaattgacaatcagacttggttgaatttcgcgcaaaaccgctaa

SEQ ID NO: 877 - DNA, 3756 bp, synthetic construct
  misc_feature 1..3756: note = Description of Artificial Sequence: Synthetic polynucleotide
  source 1..3756: mol_type = other DNA
atgctttttcaagatttcacccatctttatccacttagcaaaacggtacgcttcgagcttaaaccaatcggaaaaactttagaacacattcatgcaaaaaactttttatcccaagatgaaacgatggctgacatgtaccagaaagttaaggcaattttggatgattatcatcgcgacttcattactaagatgatgtcggaggtaacactgacaaaattgccagagttttacgaggtgtatttagctctgcgcaagaaccccaaggacgacaccttgcagaaacaattgacggaaatccagacagcgttacgcgaggaagttgtgaagcccatcgattcgggcggtaaatataaagcagggtatgagcgcctgttcggtgctaaacttttcaaggatggcaaggagctgggtgacttagccaagttcgtgatcgcccaagaaggcgaatcatcacccaagcttccgcagattgcccactttgaaaaattttctacctattttacgggatttcacgataaccgcaaaaatatgtattcttccgatgacaaacatactgctatcgcctaccgtcttattcatgaaaatttgcctcgtttcattgacaatttgcaaatccttgtaacaatcaaacagaaacatagtgtgttgtacgaccagattgtcaatgagctgaacgcaaacgggctggacgtgagcttagcaagccatctggatgggtaccacaagttgttaacccaagagggaatcaccgcatacaaccgcatcatcggtgaggtcaattcctatactaacaaacataatcaaatctgccacaaaagcgaacgtatcgcgaaacttcgccccttacacaagcaaatcttgagcgacggcatgggagtatccttccttccgagtaaatttgccgacgattctgagatgtgtcaagctgtaaatgaattctatcgtcactatgcacatgtctttgccaaagttcagagcttgtttgaccgtttcgacgattaccagaaagatggcatttacgtagagcataagaacttgaatgagctgagcaagcaagcctttggagacttcgctttattgggacgtgtgctggatggctattacgtggacgttgtaaacccagagttcaacgataagttcgcgaaagcgaagacagacaacgcaaaagaaaaattaacaaaggaaaaagacaaatttattaaaggggttcattctcttgcctccttggaacaagcaatcgaacattacattgcaggccacgacgatgagagcgttcaggcgggaaaattaggccaatactttaagcatgggcttgctggcgtcgataacccgattcaaaaaattcataactcccacagcacaattaaggggtttcttgagcgtgagcgccctgctggcgaacgcacactgcccaagatcaaatccgacaaatccttggagatgacacagctgcgccagttgaaggagttgttagataatgcgttaaatgtagtacattttgcaaagttactgactacgaaaacaacccttgacaaccaagatggcaatttttatggggagtttggtgccttatacgatgagcttgctaaaatcgccacattatataataaagtgcgcgattatcttagtcagaagcctttctccacagaaaagtacaagttaaactttggaaacccaacgttgctgaatgggtgggatttaaacaaggaaaaagataatttcggagttatcttacaaaaagatgggtgttattaccttgcattgctggacaaagcccataaaaaggtattcgacaatgcaccgaacacaggtaaatcggtctatcaaaagatggtgtataaacttcttcctggatcaaacaagatgctgccgaaagtattcttcgcgaagagtaaccttgactattataatccttcggccgaattacttgacaaatatgctcagggcacacacaaaaaaggtgataactttaatctgaaagattgtcatgctcttattgatttctttaaggctagcattaacaaacatcccgaatggcagcacttcgggtttgaatttagcttaacttcttcctaccaggatctttctgatttctaccgcgaggtggaacctcaaggttatcaagttaagttcgtagatatcgatgcagactacatcgacgaacttgtggaacaaggccaactgtatttatttcaaatctataataaggactttagtcccaaagcgcatgggaaaccgaatttgcacaccctttactttaaggcgctttttagtgaagacaatcttgcaaatcccatctataagcttaacggcgaagctgagatcttttaccgcaaagctagtttagatatgaacgaaactacaattcaccgtgcgggggaggtgctggaaaacaaaaatccggacaatcctaaagaacgtcagtttgtatatgacatcatcaaagataagcgttatacgcaggataagtttatgctgcatgtgcccatcactatgaactttggagtacaagggatgaccatcaaagagtttaataagaaagttaatcaatcgatccaacaatatgacgaggttaacgtgatcggaatcgatcgcggagagcgccacttattatacttaacggtcatcaactcgaaaggtgagattttagagcagcgttctttgaacgacatcattacgaccagcgcgaatggtacgcagatgacgacgccttaccataaaattcttgataaacgtgaaattgaacgtttaaatgctcgcgtaggttggggcgaaattgagacgattaaggaactgaagtccggatatctttcccatgtggttcatcaaatctcacagctgatgttgaaatacaatgccatcgttgttttagaagatttaaatttcggctttaaacgcgggcgctttaaagtggaaaagcaaatttaccaaaacttcgaaaacgcccttattaagaaacttaatcacttagtattgaaggacaaagccgataacgaaattggtagttacaagaacgccttacagcttactaataatttcaccgatttaaaaagcattgggaaacaaacaggctttttgttctacgtcccagcctggaacactagtaaaattgatcccgttacaggttttgtagacctgcttaagcctcgttatgaaaacattgctcaatctcaagcattcttcgacaagtttgataaaatctgctacaatgcggataaagggtacttcgagttccacatcgactatgcaaagtttaccgataaggcaaaaaattctcgtcagatctggacaatctgtagccatggggataaacgttatgtgtatgataagactgctaaccaaaataagggggctacaattggtattaacgttaacgatgaattgaaaagtctgtttgcccgttaccgtatcaacgataaacagccgaacttggttatggacatctgccaaaacaatgacaaagagtttcataagtccttgacttatcttcttaaggcattattagctctgcgttacagtaacgcttcgtctgacgaagactttattttatcaccggtggcgaatgacaagggcgtttttttcaattctgcgttagctgacgatacgcagccgcagaatgccgatgcaaatggtgcttatcatattgccctgaaagggttgtggttgttgaacgagttaaaaaactccgatgatttagacaaagttaaattagcgattgataatcaaacgtggctgaacttcgctcaaaaccgttaa

SEQ ID NO: 878 - DNA, 3774 bp, unidentified
  misc_feature 1..3774: note = Description of Unknown: Bacteroidales sequence
  source 1..3774: mol_type = genomic DNA
atgaagtataccgattttacaggcatttatcctgtgtctaagactttaagatttgagctcattccacaaggatctactgtggagaacatgaaacgcgagggcattctgaacaacgatatgcatcgtgccgatagctacaaggaaatgaaaaaattgattgatgagtaccacaaggtatttatcgagcggtgcttgtctgatttctccctgaagtatgacgatacgggaaaacacgattctcttgaggaatattttttctactacgagcaaaagagaaacgataagacaaaaaaaatctttgaggatatccaagtcgctttgcgtaagcaaatttcaaaaaggtttactggcgatactgcgtttaaaagacttttcaagaaagaactcatcaaagaagacttgcccagttttgtaaaaaacgacccagttaagactgaactgataaaggagttttctgatttcaccacctattttcaggaattccacaagaatcgcaaaaacatgtatacatctgatgcgaaatctactgctattgcctaccgcatcatcaacgaaaacttgcccaaattcatcgacaatatcaacgcatttcacattgttgccaaggtgcccgaaatgcaagagcattttaagacaatagccgatgagcttaggagccacttacaggttggagatgacatcgataagatgtttaacctgcaatttttcaacaaagtgctgactcagtcacaactcgctgtatataatgccgttataggaggcaagagcgagggaaacaagaaaatacaaggcatcaatgagtatgttaacctttataaccagcagcataaaaaggcgcgcttgccaatgctgaaactgctgtataagcagatcttgagcgatcgcgttgccatttcatggttacaggatgaatttgataatgaccaggacatgcttgatacaatagaagccttctataacaagcttgatagtaatgaaactggtgtgctgggcgaaggcaagctcaagcaaatactcatgggactggacggctacaatttggatggagtgttcctgcgcaacgatttgcagctctccgaagtttctcagcgcctgtgcggtggctggaatataataaaggatgccatgataagtgacttgaaacgtagtgtacagaagaagaaaaaagaaactggtgccgattttgaagagcgtgtatcaaaacttttctctgcccagaacagtttctcaattgcttatatcaaccagtgccttgggcaggcaggaataaggtgtaagattcaagattactttgcttgtcttggtgcaaaagagggtgaaaacgaagcagagacgactcccgacattttcgatcaaattgctgaggcttaccatggggccgctccaatattaaatgctcggccaagcagtcataatttggctcaggatattgagaaggttaaagcaatcaaagccttgcttgatgcgctcaagcgcttgcagcgatttgtcaagccattgcttggtcgtggcgatgagggcgataaggatagtttcttctatggcgattttatgccgatatgggaagttctcgaccagctcactccgctgtacaacaaggttcgaaaccgaatgactcgtaaaccctattcgcaagaaaaaatcaaacttaatttcgagaatagtacgctgttgaatggctgggacttgaacaaagagcatgataacacaagcgtgattttgcgccgcgaagggttgtactacttaggcatcatgaataaaaactataataaaatatttgatgccaacaatgttgaaaccataggagactgttacgaaaaaatgatttataaacttttgccgggtcccaacaagatgcttcctaaggtgttcttctccaaatcaagagtgcaggaattctctccgagcaagaaaattcttgaaatttgggagagtaagtcttttaagaaaggtgataatttcaatctcgacgattgtcatgctctcatagatttctataaagattctatagcaaagcatcccgactggaataaatttaacttcaagttctctgatactcagtcatatacaaatattagtgatttttatcgtgatgttaatcagcagggttactccctttctttcacaaaagtgagtgttgactatgtcaacaggatggtggacgaaggcaagctatatcttttccaaatctacaataaggacttttcaccccaaagcaagggtacacccaacatgcacaccctatactggcgcatgctctttgatgagcgcaacttgcacaatgttatttataagctcaatggtgaagccgaagtgttttaccgcaaggcaagcctaaggtgcgatcgacctactcaccccgcacatcagcctattacttgcaaaaacgaaaatgactccaaacgtgtgtgtgtgttcgactacgacattattaaaaatcgccgatacaccgttgataaattcatgtttcatgttcctataacaataaattataagtgtactggcagcgacaacatcaatcagcaggtgtgtgattatttgcgctcggcaggcgatgacactcacatcataggcatcgaccgtggagagcgcaatttgctctacttggtgataatcgaccagcatggtactattaaggagcaattttcgcttaacgagattgtcaacgagtacaagggtaatacctattgcaccaattatcataccttacttgaggagaaggaagctggcaacaagaaagcccggcaagactggcaaactattgaaagcataaaagaactcaaagagggctatctgtcgcaggtaatccacaagatctctatgctcatgcagcgttatcatgccattgttgtacttgaagatttgaacggttcgttcatgcgtagcaggcaaaaagtggaaaagcaggtatatcagaaatttgagcacatgctcatcaacaagcttaactacttagtcaacaagcaatatgatgctgccgagccaggaggcttgttgcacgcattgcaactcacgagcagaatggatagttttaaaaagctgggcaagcaaagcggtttccttttctatattccagcatggaatacttcaaagattgatcctgtgactggatttgtcaacctttttgacactcgttactgcaatgaagccaaagctaaggagttctttgaaaaatttgacgacataagctacaatgacgagcgtgattggtttgagttttcttttgattatcgtcattttaccaacaagcctactggaactcgtactcaatggacactatgcacccaagggacacgtgtacgcacttttcgcaatcccgagaaaagcaatcattgggacaatgaggaattcgatctcacacaagcatttaaagacctctttaacaaatatggcatcgatatcgcttcgggacttaaagcccgtatagttaacgggcagctcactaaagaaacctctgcagtcaaagacttctatgagtcgttgcttaagttactaaaactcactttgcagatgcgaaatagtgtcactggtactgacattgattatcttgtatcccctgtggctgataaagatggtatttttttcgacagccgaacttgcggtagccttttacctgccaatgccgacgccaatggagctttcaatatagcacgaaaaggattgatgttgttacgtcagattcaacaaagctcaattgatgcagaaaagatccagctcgctcccattaaaaatgaagattggcttgaattcgctcaggagaaaccatacttgtaa

SEQ ID NO: 879 - DNA, 3774 bp, synthetic construct
  misc_feature 1..3774: note = Description of Artificial Sequence: Synthetic polynucleotide
  source 1..3774: mol_type = other DNA
atgaaatacacggacttcacgggtatctacccagtgtcgaagacactgcgctttgaattgattccccaaggctccactgtagaaaatatgaagcgtgagggaattctgaataacgatatgcatcgcgcagacagctacaaagagatgaagaagcttattgatgaatatcataaagtctttatcgagcgctgtttaagcgatttcagccttaaatatgatgacaccgggaaacacgattcattggaagagtattttttctactacgaacagaagcgtaatgacaagacgaagaagatctttgaagacatccaagtcgcattgcgcaaacagatcagtaaacgcttcacaggcgatactgcttttaagcgcctttttaagaaggaacttatcaaagaagatctgccgtcctttgtaaaaaacgatccggttaagacggaattgattaaagagtttagtgatttcactacgtatttccaagaatttcataagaaccgcaagaacatgtatacttcagatgctaaatctacggcaatcgcctaccgtattattaatgagaatcttcctaagttcatcgacaatattaacgcttttcacattgtagcaaaggttcctgaaatgcaagaacattttaagacgattgcggatgagctgcgttctcaccttcaagtgggtgacgacattgacaaaatgttcaatttacaattttttaataaggttcttacacaatcacaacttgccgtgtacaacgccgtaatcggcggtaagtctgagggcaataagaaaatccagggcattaacgaatacgtaaatctgtataaccaacagcataagaaggcccgtcttcctatgcttaaactgttatacaagcagatcttgagcgaccgcgtggcaatttcatggctgcaggatgaatttgataacgatcaggacatgcttgacacaatcgaggccttttataataagctggatagtaacgaaacgggagttctgggagaaggtaagttaaagcagattttgatggggctggacgggtataatcttgatggggtcttcttacgcaacgacctgcagttgagcgaggtgtcccaacgcctgtgcggaggctggaacatcattaaggacgcgatgatttcggacctgaaacgcagtgtacagaaaaaaaagaaggaaactggagcggactttgaggaacgcgtctccaaactttttagtgctcaaaatagtttttcgatcgcttatatcaaccagtgcctggggcaggcgggaattcgctgtaagatccaagattattttgcgtgcttgggggcaaaggagggggagaatgaagctgagactactccagatatttttgaccagattgcagaggcttatcatggggcggcaccaattcttaatgcccgccctagctctcataacctggcgcaggacatcgagaaggtgaaagcaatcaaagctctgcttgacgcactgaaacgcctgcaacgctttgtgaagcccttattaggccgcggagacgaaggcgataaagatagcttcttctacggggacttcatgccgatctgggaggtacttgatcagttaacccccttatataataaggtgcgtaaccgtatgacgcgtaaaccatactcgcaggaaaagattaaattaaactttgagaactctactttactgaacgggtgggacctgaataaagaacacgacaatacatcagtgatcttacgccgtgagggactttattatctgggcatcatgaacaagaattataacaagattttcgacgcgaacaatgtcgaaacaattggcgattgctacgagaaaatgatctataagttgttaccgggtccaaataaaatgcttcctaaagtgttctttagcaaatcgcgcgtgcaggaattctcgccaagcaagaagatcttagaaatctgggaatcgaaatcctttaaaaaaggagataactttaaccttgatgactgccacgcccttattgacttctacaaagattcaattgctaagcaccctgactggaataagtttaactttaagttttccgacacccagtcatacactaacatttctgacttctatcgcgacgttaatcaacaaggctacagtctttcattcacgaaggtgtcggtggattacgttaatcgcatggtcgatgagggtaagttataccttttccagatctataataaagacttttcgccccagtcgaagggaactccgaatatgcacaccttgtattggcgcatgcttttcgacgaacgcaacctgcacaatgttatttacaagttaaatggtgaagccgaggttttctatcgtaaggcatcactgcgttgtgatcgtccgacgcacccggcacatcaacccatcacgtgcaagaacgaaaacgattcgaaacgtgtctgtgtattcgactatgacatcatcaaaaaccgtcgctacactgtggataagtttatgtttcatgtccccattacgatcaattacaaatgtacaggaagcgacaacattaaccagcaagtatgcgattacttgcgtagcgcgggagatgatacacacatcattggtattgatcgtggtgagcgcaacttgctgtatcttgtgattatcgatcaacacggaacgattaaagagcagttttcgttgaacgagatcgtgaatgagtacaaaggcaacacgtactgtacaaactatcacactttgcttgaggagaaagaggcgggtaacaaaaaagcgcgtcaagactggcaaacaatcgagagcattaaagaattgaaggaaggatatttgagccaagtgatccacaaaatctcgatgttaatgcaacgctaccacgctattgtagtattagaggatttgaatggaagtttcatgcgcagccgccaaaaagtagaaaaacaagtttatcaaaagttcgaacacatgttaatcaacaaacttaattatcttgtcaataagcagtatgatgctgcagaaccgggtgggttattgcatgctttacagcttacttcgcgtatggatagctttaaaaagttaggtaaacagtccgggttcctgttttatatccctgcgtggaatacttccaagattgaccctgtcaccgggttcgtaaaccttttcgacacccgctactgcaacgaggcaaaggcgaaggagttttttgaaaagtttgacgatatttcatataatgacgaacgcgactggttcgagttttcattcgattaccgccatttcacaaataagcccacaggaactcgtacccagtggaccttatgcacccaaggcactcgtgttcgcacattccgtaaccctgagaaatcaaatcactgggataatgaggagtttgacctgacccaggcctttaaggatttatttaataaatacggtatcgacatcgcgagcggcttaaaggcacgtattgtcaacggccagcttacgaaggaaactagtgcagtcaaagacttctacgagagtctgctgaagttgttgaagctgactcttcaaatgcgtaattcagttacagggacagacatcgattacctggtgagcccagttgcggataaagatggtatctttttcgattcgcgtacttgcggctcattgctgcctgcaaacgcggatgccaacggagcgttcaacattgctcgtaaggggttgatgctgcttcgccaaattcagcaatccagtattgatgccgaaaaaattcagcttgccccaattaaaaatgaagactggcttgaatttgcacaagaaaagccatatttataa

SEQ ID NO: 880 - DNA, 3774 bp, synthetic construct
  misc_feature 1..3774: note = Description of Artificial Sequence: Synthetic polynucleotide
  source 1..3774: mol_type = other DNA
atgaaatacacggacttcaccggcatctacccagtttctaagacactgcgcttcgagttgattccacaagggtcgacagtagagaacatgaaacgcgagggtattcttaacaatgacatgcaccgtgcggactcgtataaagaaatgaaaaagctgattgacgaatatcataaagtgttcatcgaacgttgcttatcagatttttcccttaagtatgatgatacaggtaagcacgactccttagaggaatattttttttactatgaacaaaagcgcaacgacaagactaagaaaatcttcgaggatattcaagtggcgctgcgcaagcaaatctcaaaacgctttaccggggacactgccttcaaacgcctttttaagaaggaattaattaaagaggatttgccgtcattcgtaaaaaacgatccagtcaaaacggaacttattaaggagttctcggattttaccacttactttcaggaatttcacaagaaccgcaaaaacatgtatacatcagatgccaaatcgaccgccatcgcatatcgtatcatcaatgagaacctgccgaagtttatcgataatatcaacgcgttccatattgtggctaaagtgccagaaatgcaagagcactttaaaaccattgcggatgaactgcgctctcatcttcaggtgggggatgatattgacaaaatgtttaacttgcaatttttcaataaagtccttacgcagagccagctggccgtatataatgctgtgatcggtgggaaatctgaaggtaacaaaaaaattcaagggatcaacgaatacgtaaatttgtacaaccaacaacacaaaaaggcacgcctgcccatgttaaagttgctttacaaacaaatcttatctgatcgtgtggccatttcttggcttcaggacgagtttgataacgaccaggacatgttagacacgattgaagccttttacaacaaacttgactcgaatgaaaccggcgtgttgggtgaggggaagctgaagcagattttaatgggcctggatgggtacaaccttgacggcgttttcctgcgcaatgacctgcaattgtccgaagtatcgcagcgtctgtgtggaggctggaacattattaaggatgctatgatttctgatttgaaacgttccgtccaaaaaaaaaaaaaggaaacgggagcggatttcgaagagcgtgtctctaagctttttagcgcccaaaactccttctctatcgcatatattaatcagtgccttgggcaggcaggtattcgctgtaaaatccaagactactttgcatgcttgggcgccaaagagggcgaaaatgaagcagagacgacaccagatatctttgaccaaatcgccgaagcctaccatggtgcggcacccattttgaacgctcgcccaagctcacacaatttggcacaggatatcgaaaaggtaaaggctatcaaagccttacttgacgccttgaagcgcttacagcgttttgtgaagcctttattaggccgtggcgacgaaggtgataaagattcttttttctacggtgacttcatgcctatttgggaggtgttagaccaactgactcccctgtacaataaggtgcgcaatcgtatgactcgcaaaccttacagccaagagaagatcaagcttaactttgagaactcaacacttttaaatggatgggacttaaataaagaacatgataacacatctgtgattttacgtcgtgagggcttgtactatttaggcattatgaataaaaactacaataagatttttgacgcgaacaatgtagagacaattggcgactgttatgaaaagatgatttacaagttgcttccaggtccaaataaaatgttgccgaaggtctttttttcgaaatcacgcgtccaagaattttctccaagcaaaaaaatccttgaaatctgggaatctaaaagttttaagaaaggagacaattttaatttagacgattgtcacgcgctgattgacttctacaaagatagcattgccaaacacccggattggaacaaattcaatttcaagttcagtgacacgcagtcgtatacgaacatcagtgatttctatcgtgatgttaatcaacagggttattcgttatccttcacaaaggtgtcagtagactatgttaaccgtatggtcgacgaaggcaagctttatcttttccagatttataacaaggacttttcgcctcaatcaaagggtacgccgaacatgcataccctttactggcgcatgcttttcgatgagcgcaatttacacaacgttatctacaaactgaacggcgaggctgaggttttttatcgcaaagctagtttgcgttgcgaccgtccaacccatccggcgcaccagcccatcacctgtaaaaatgagaacgattccaagcgcgtttgcgttttcgattacgatattatcaagaaccgtcgttatactgtagacaagtttatgtttcatgtaccgattacgattaactataagtgcactgggtcggacaatattaatcagcaagtatgtgactatttgcgcagcgctggcgatgatactcacatcatcggcattgatcgcggagaacgcaatttattgtaccttgtgatcattgaccagcatggaacgatcaaggagcagttctcattaaacgaaattgtcaatgaatacaagggtaatacctactgcactaattatcataccttgcttgaagagaaagaagcgggcaacaagaaggcccgtcaggattggcaaacgattgaatctatcaaggaacttaaggaaggatatctttcgcaggttattcataaaattagcatgcttatgcaacgctatcatgctattgtagtcctggaggatcttaacggtagctttatgcgctctcgccaaaaggttgaaaaacaagtctatcaaaaattcgagcatatgctgattaacaaacttaattatctggttaacaagcagtatgacgccgcggagccgggcgggcttcttcacgctcttcaattaacttcccgtatggacagttttaaaaagctggggaaacagtctggttttttattttacatccccgcttggaatacatcaaagattgatccagtcacggggtttgtcaacttgtttgatacacgttattgtaacgaggctaaagcgaaagaattttttgaaaaattcgacgatatctcctataacgatgaacgtgattggtttgagttttcattcgactatcgccactttacgaacaaaccgacgggtactcgtacccagtggactttgtgcacacaaggtacacgtgttcgcactttccgcaacccggaaaagagtaatcattgggataacgaagagttcgaccttactcaagcgttcaaagatttgtttaataagtatggaattgatatcgctagtgggcttaaggcgcgcatcgttaatggccagttaaccaaggagacctcagctgtgaaggatttctatgaatccttgctgaaattactgaagcttacattacaaatgcgtaactctgtgaccgggaccgatatcgattatctggtcagcccggttgctgacaaggacggtatcttcttcgattcgcgtacttgcggtagtttgcttcccgccaacgcggatgcaaacggagcctttaatattgctcgtaaagggttaatgcttcttcgccaaatccaacagtcctctatcgacgcagaaaagattcagttggcacccattaagaacgaagattggttggagtttgcccaggagaagccctacttgtaa

SEQ ID NO: 881 - DNA, 3774 bp, synthetic construct
  misc_feature 1..3774: note = Description of Artificial Sequence: Synthetic polynucleotide
  source 1..3774: mol_type = other DNA
atgaaatatactgacttcactggcatctatcctgtgtccaaaacccttcgcttcgaattgattcctcaaggttccacggtagaaaatatgaaacgcgaggggattctgaacaatgacatgcatcgcgcagattcttacaaagagatgaaaaagttgattgacgagtaccataaggtctttatcgaacgctgtctgagcgacttctccctgaagtatgatgatacggggaagcatgatagcttagaagaatacttcttctattacgaacaaaagcgcaacgataaaacaaagaagattttcgaagatatccaagttgcattgcgcaaacaaatcagcaaacgttttacgggggataccgcattcaagcgtttatttaagaaggagcttatcaaggaggatttgccatcgttcgtcaaaaatgacccggttaagactgagcttatcaaagaattttcagacttcacaacttactttcaggagttccacaaaaatcgtaaaaacatgtacacaagtgatgcgaaatctacagccatcgcataccgtatcattaatgaaaaccttccaaagttcatcgataacattaatgctttccacatcgttgcaaaagtacctgaaatgcaggaacacttcaaaactatcgcagatgaattgcgttcgcatttacaagtcggggatgatattgacaaaatgtttaatttacagttttttaataaggtgttgacccaatctcaattggcggtctataacgcagttattggtggcaaaagcgaagggaacaaaaagatccaaggcatcaacgaatacgttaatttatacaaccaacagcacaagaaggcgcgcttgcccatgttgaaactgttatataaacagatccttagtgaccgtgttgcaatctcgtggttgcaggatgaatttgacaatgaccaagatatgttggacaccatcgaggccttttacaataagttagacagcaatgaaaccggagtactgggcgaaggaaagttgaaacaaatcttaatgggtcttgatggatataacctggatggcgtatttttacgcaacgatttacaacttagtgaagtttcccaacgtctgtgtggcgggtggaacattattaaggacgcgatgatttctgatttgaaacgttcagtgcaaaagaaaaaaaaagaaacaggggccgattttgaagaacgcgtcagcaaattattctctgcacaaaattcgttttcaattgcttacattaatcaatgtttggggcaggctggcattcgctgtaaaattcaagattacttcgcttgccttggtgcaaaggagggtgaaaacgaggctgaaaccacaccggatattttcgaccaaattgccgaagcgtatcatggcgccgcaccgatcttaaatgcgcgtccctcttcgcacaatctggcacaggatattgaaaaagtcaaagctattaaggctcttttagacgcattaaagcgcttgcaacgttttgtaaaacctcttttaggccgtggcgatgaaggagacaaagattctttcttttacggcgacttcatgccaatctgggaggttttagaccagttaacgccgctgtataataaggtgcgcaaccgcatgacgcgtaaaccatactcacaagagaaaatcaagttgaactttgagaactcgactttgctgaatgggtgggatttgaataaagagcacgataacacaagtgtaattctgcgtcgcgaggggttgtactatttaggaattatgaataaaaattacaataagatttttgatgcaaataacgtagaaacaatcggcgactgttatgagaaaatgatctataagcttttacccgggccaaataaaatgttaccaaaagtgtttttttcaaaaagtcgcgtacaggagttctccccgagcaagaagattctggaaatctgggagagcaagtctttcaaaaaaggtgacaatttcaacttagacgattgccacgcgcttattgacttttacaaagacagtatcgcgaagcaccccgattggaacaaatttaatttcaagttttcagacacgcagtcttacacaaacatttctgatttttatcgtgatgtaaaccagcaggggtactccttgtccttcactaaggtaagtgtagattatgttaatcgtatggtagatgaggggaagttgtaccttttccaaatctacaacaaagattttagtccccaatcaaagggtacgccgaacatgcacactctgtattggcgtatgctttttgacgagcgcaaccttcataatgttatctacaagttaaacggagaagcagaggtattttatcgcaaagcctctcttcgctgcgaccgcccgacacacccagcccatcagcctatcacatgcaaaaacgagaacgatagtaaacgtgtgtgtgtgttcgattatgacatcattaagaaccgtcgctataccgtcgacaagttcatgtttcacgttcccattacaattaactataagtgcacgggatcggacaatatcaaccaacaggtctgcgactacttgcgcagcgctggcgacgacactcacatcattggtattgatcgtggtgagcgcaacttattatacctggtaatcattgaccaacatgggaccattaaggagcagttttctttgaacgaaattgtcaatgagtacaaaggtaacacgtattgcaccaattatcatactctgctggaagagaaagaggccgggaataaaaaggcacgccaagactggcagacaattgagtcgattaaagaactgaaagaagggtaccttagccaggttatccataagattagtatgttgatgcaacgctaccacgcaattgtcgtattggaggacttaaatggtagctttatgcgctcccgccagaaagtcgaaaaacaggtctaccaaaaattcgagcacatgttgatcaataagttgaattacctggtaaataaacaatacgatgcggccgaaccgggtggcctgttgcacgccttacagttgacctcccgtatggattcctttaagaaattgggcaagcaatctggctttcttttttatatcccggcatggaatacttcgaaaattgaccccgttacgggttttgttaacttattcgacacccgttattgtaatgaagcgaaggccaaggaattctttgaaaagtttgacgatatcagttataacgacgagcgcgattggttcgagttttccttcgattatcgccacttcacaaataaacctactgggacgcgtacccagtggactctttgtacccaagggactcgtgtccgtacctttcgcaatcccgaaaagtcaaatcactgggacaatgaggaatttgatttgactcaggcgtttaaagaccttttcaataagtatggtatcgacattgcgtctggtcttaaggcacgtatcgttaatggccagcttaccaaagagacctctgcggtgaaagacttctatgagtctctgttgaaactgttaaaactgacgttgcaaatgcgcaactccgtcacaggaactgatattgactacttagtgagccctgtcgcagataaggacggtatttttttcgattcacgcacgtgtggcagtttactgcccgcaaatgcggatgccaatggcgcgttcaatattgcgcgtaaggggttgatgttactgcgccagattcagcagtcatcaattgatgcggaaaaaattcagttagcccccatcaaaaatgaggactggttggaatttgcgcaagaaaaaccttacctgtaa

SEQ ID NO: 882 - DNA, 3738 bp, Phocaeicola plebeius
  source 1..3738: mol_type = genomic DNA
atggaaacattttctgggtttacaaatttgtaccctttgtcaaagacattgcggtttagattgattcctgtaggggaaacattgaaatattttattggtagtggaatattggaagaagaccagcatagggctgagagctatgtgaaggtaaaggctattattgatgactatcatagagcttatattgagaattctttatcaggctttgaattacctttggaaagtacgggtaaattcaattctttggaggaatattatttgtatcataatattcgcaataaaacggaagaaattcagaacttgtcatccaaggtcagaactaatctgaggaaacaagtcgtggctcaactaactaagaacgaaatatttaaaagaattgataaaaaagagctgattcagagtgatttgattgattttgttaaaaatgagcctgatgcaaatgagaaaatagcactaatctcagaatttcgtaattttactgtatatttcaaaggttttcatgaaaaccgtagaaatatgtattcagatgaagaaaagtccacgtctatagcctttcgtctgattcatgagaatcttcccaagtttattgataatatggaagtgtttgcaaaaatacagaatacttctatctcggagaattttgatgctatacagaaagaactttgcccggagttggtaaccctttgtgaaatgtttaagttggggtattttaataagactttaagtcagaaacaaatagatgcttataatactgttataggtggtaaaaccacatcagaaggtaaaaagattaaaggtcttaatgaatatattaatctttataaccagcagcataagcaagagaaattacccaagatgaagcttcttttcaagcagatacttagtgatagagaaagtgcgtcatggctgccagagaagtttgagaatgatagtcaggttgtcggtgcaatagtgaatttctggaatactattcatgatacagttcttgcagaaggagggttgaaaacgattattgcttcattgggtagttatggccttgaaggtattttcctaaagaatgatttgcaacttactgatatatcacaaaaggcaacaggtagttggggtaaaatatcttctgagataaagcaaaaaatagaggtgatgaatcctcaaaagaaaaaagagtcttatgagacttatcaagaacgtatagataagatattcaagtcttataaaagtttttctttagcttttataaatgagtgccttcgtggtgagtataagattgaagattattttctcaagttaggggctgtgaatagcagttcgttacagaaagaaaatcatttttcgcatattctcaatacctatacagatgtgaaagaggtgattggcttttactctgaatcgactgacactaaattaatacgagataatggttccattcaaaagataaaactgtttcttgatgcggttaaagacttacaggcttatgtaaaaccattattgggtaatggtgatgaaaccggtaaagatgaaagattttatggcgatttgattgagtattggagtttgcttgacttgattactcctttatataatatggttcgtaattatgtcactcagaagccgtattctgtagataaaataaaaataaatttccagaatcctactttattgaatggctgggaccttaataaagaaacggataatacatctgtaatattgcgtcgtgatggcaaatattatctggccataatgaataacaaatccagaaaagtctttttgaaatatccatcagggacagatagaaattgctatgagaagatggagtataaacttttaccaggtgctaataagatgctacctaaggtcttcttttcaaaatcaaggataaatgaattcatgcctaatgagcgtttgttgtcaaattatgaaaagggcacgcataaaaagtcgggtacttgttttagtttggatgattgtcatactttgatagatttctttaagaagtctttggacaaacatgaggattggaaaaactttggcttcaagttctctgatacttctacatatgaagatatgagtggtttttataaagaagtagagaatcaaggttataaattatcctttaagccgattgatgctacgtatgtggatcagcttgttgatgaaggtaagatttttctgtttcagatttataacaaggatttttctgagcatagcaaaggtacgcctaatatgcataccttgtattggaaaatgttgtttgatgaaacaaatcttggggatgtggtgtataaactaaatggtgaggctgaagtctttttccgtaaggcaagtataaatgtatcacatccaactcatccggctaacatacccataaagaaaaagaatcttaaacataaagatgaagaaagaattcttaaatatgacttgattaaagataagcgttataccgtcgaccagttccagtttcatgtgccaataaccatgaatttcaaggcggatggaaatggaaatataaaccagaaagcgatagactatttacgttcggcatcagatactcatataatagggattgaccgtggtgaacgaaacttgttatatcttgtagtgattgatggaaatggaaaaatctgtgagcaattctctttaaatgaaatagaagttgaatataatggtgaaaagtattcaacaaattaccatgatttgcttaatgtcaaggagaatgaaagaaagcaggcaagacagagttggcaaagtatagctaacataaaagacttgaaagaaggctatttaagtcaggttattcataagatttctgaattgatggtcaaatataatgcgattgtggtgcttgaggatttgaatgctggatttatgcgtggtcgacaaaaggttgaaaagcaggtttatcagaaatttgaaaagaaactcattgagaagttaaattatctcgtattcaagaaacagtcttctgatttgcctggtgggcttatgcatgcttatcagttagctaataaatttgagagttttaatactttaggtaaacaaagcggatttctcttttatatccccgcctggaataccagtaaaatggatccggtaacaggttttgtaaatttgtttgatgtgaagtatgaaagtgttgataaggcaaaaagctttttcagtaagttcgattctataaggtataatgtggaaagagatatgtttgaatggaaattcaattatggtgaattcacgaaaaaagccgaaggaactaaaactgattggactgtttgttcctacggtaatagaattatcacctttagaaatccggataaaaattctcaatgggataataaagaaataaatcttaccgaaaatattaagctgctgtttgaaaggtttggcatcgacttatcttcaaatctgaaagatgagataatgcaacgtacagaaaaagaattctttatcgaacttatatccctatttaagcttgtgctacagatgcgtaatagttggacaggtactgatatagattatctggtatcacctgtatgcaatgaaaacggtgaatttttcgatagcagaaacgtagatgaaacacttccgcaaaatgcggacgcaaacggagcatataacattgcaagaaaaggaatgatacttcttgataagattaagaaaagtaacggtgagaagaagcttgctctatctataactaatagagaatggctttcatttgctcaaggttgttgcaaaaatggatga

SEQ ID NO: 883 - DNA, 3738 bp, synthetic construct
  misc_feature 1..3738: note = Description of Artificial Sequence: Synthetic polynucleotide
  source 1..3738: mol_type = other DNA
atggagacattcagcggctttactaatttatacccacttagtaaaactcttcgttttcgtttaatccctgttggcgaaactttgaaatacttcatcgggtcaggtattttggaagaagatcaacaccgcgcagagtcatacgtaaaagtcaaagccatcattgacgactaccaccgtgcttatatcgaaaattctctgtctggttttgaactgcctttggaatcaactgggaagttcaatagtcttgaagaatactatctgtaccacaatatccgcaataaaacagaggaaattcaaaacttgtcgtcaaaagtccgtactaacttgcgcaagcaagtcgtggcgcagttaaccaaaaatgagatcttcaagcgtattgacaaaaaagaactgatccaatcagacttaattgatttcgtaaagaatgaaccagacgcaaacgagaaaattgcactgatctcagagttccgtaattttacggtgtattttaaagggtttcatgaaaaccgtcgcaacatgtattccgatgaggagaagtcgacttccattgctttccgcttgattcacgaaaatttgcccaaattcattgacaatatggaggtttttgcaaaaattcagaacacgtcaatttcggagaacttcgacgcgattcagaaggagttgtgtcctgagctggttacgttgtgtgagatgttcaaactgggatactttaataagactctttcgcaaaaacaaatcgacgcttacaatacagttattggcgggaagactactagcgagggcaaaaagatcaagggtttgaatgaatatatcaacttgtataatcagcaacataaacaggagaaacttcccaagatgaagcttctgttcaaacaaatcttgtcagaccgcgaatcagcctcatggttgccagagaagttcgaaaacgacagccaagtcgtaggggctattgtaaacttctggaatactattcacgatactgtgttggccgaaggtggattgaagacgatcattgcgagcttaggctcttacgggttagaggggatcttcctgaaaaacgatttgcaactgacggacatttcccaaaaggctactggaagctgggggaagattagctccgagatcaagcaaaagatcgaagttatgaacccccagaagaaaaaagaatcgtatgaaacttaccaggagcgcatcgataaaatttttaagagctataaaagtttttctcttgcttttatcaacgaatgcttacgtggggagtataagatcgaggattatttcctgaagctgggtgcggtaaactcctcatctttacagaaggaaaaccatttttcacatattctgaatacatatactgacgttaaggaggtgattggattttattcagaatctactgacaccaaattaatccgtgataatgggagtattcaaaaaattaaattgtttttggatgcagtaaaagaccttcaggcgtacgtcaagcctcttttgggaaatggggacgaaacagggaaagatgagcgtttctatggggaccttattgagtattggtcacttcttgatttgattacaccactttataatatggtccgtaactacgtcactcagaaaccatactcagtagataagatcaaaattaatttccagaacccgaccttgctgaacggctgggatttaaacaaagaaactgataacacaagcgttatcttacgtcgcgacggaaagtattaccttgccattatgaataataaaagtcgtaaagtctttttaaagtatccgtcgggtacggaccgtaactgttatgaaaaaatggagtacaagcttctgccgggtgctaataaaatgttacccaaagttttctttagtaaaagccgtattaacgaatttatgcctaacgagcgtcttttgtctaattatgagaagggtactcacaaaaaaagtgggacctgcttctcgttagatgattgtcatacacttattgactttttcaaaaagtcgcttgacaaacacgaggactggaagaactttgggtttaaattctctgatacgagcacctatgaggacatgtcaggtttctacaaagaggtcgagaaccaggggtataagttgagttttaagcctatcgatgcgacttatgtagatcagttggtagacgaaggaaaaatttttctttttcaaatttacaataaagatttctccgaacacagcaaggggactcctaatatgcacactttgtattggaagatgctgttcgacgagactaacctgggagacgttgtctacaagttgaatggagaggcggaggtattttttcgcaaggcgtctattaacgtttcgcaccccacgcaccccgccaacattcctatcaagaagaaaaacctgaagcataaggacgaagagcgcattcttaaatatgacctgatcaaggataagcgctatactgtcgatcaattccagtttcacgtaccgattactatgaatttcaaagcagatggaaacggtaatatcaatcaaaaggctattgactatttacgtagtgcttctgacactcacatcatcggaattgatcgcggagagcgcaatctgttgtatcttgtggtcatcgatgggaatggcaaaatctgtgaacagttctcgctgaatgaaattgaggtggaatataatggcgaaaagtactctacgaattatcatgatttgcttaatgtgaaggagaacgaacgtaagcaagcgcgtcagtcatggcagtctattgctaacattaaggacttaaaggaagggtatttgagtcaagtgattcataaaattagtgaattaatggtaaagtataatgcgattgttgtcttagaggatctgaacgcgggcttcatgcgtgggcgtcagaaagtggaaaagcaagtctatcaaaaattcgaaaagaagttaatcgagaaattaaactacctggtattcaaaaagcagtcgtccgatttgcccggaggattaatgcatgcttatcagcttgcgaataaatttgagagtttcaatacgctggggaaacagagcgggtttttattctatatccctgcctggaatacaagtaagatggaccctgtgacaggcttcgtcaatttgtttgacgttaagtatgaatcggtcgacaaagcaaaaagtttcttcagcaaatttgactccatccgctataatgttgaacgcgatatgtttgagtggaaatttaattatggggaattcaccaaaaaggcggaaggcacaaaaactgattggacagtgtgctcttatggcaaccgtattattacgtttcgtaaccctgataagaactcccaatgggataacaaagagatcaaccttacggaaaatatcaaactgttattcgaacgttttgggatcgatctttcttccaacttaaaggacgaaatcatgcaacgcactgagaaggagttttttatcgaactgatttcgttgttcaagctggtacttcagatgcgtaattcctggacaggaacggatattgattatttagtatcccccgtttgcaatgagaatggcgaattttttgactcacgcaacgtcgacgagaccttgcctcaaaacgcagacgctaacggggcttacaacatcgcacgcaaggggatgatccttttagacaaaatcaagaagagcaacggtgagaagaagctggccttgtcaattactaatcgtgagtggctttcatttgcgcaaggttgttgtaaaaacggctga

SEQ ID NO: 884 - DNA, 3738 bp, synthetic construct
  misc_feature 1..3738: note = Description of Artificial Sequence: Synthetic polynucleotide
  source 1..3738: mol_type = other DNA
atggaaacgtttagtgggttcacaaacctttatccgttatcaaaaactcttcgcttccgtcttattcccgttggcgagacgttaaaatatttcattggctcagggatcttagaggaagatcaacatcgcgccgagtcttacgttaaggtgaaagcgattatcgacgattaccatcgcgcttatattgagaacagcttaagcgggttcgaattacctctggaatctactgggaagtttaacagccttgaggaatattacctttatcataacattcgcaataagacagaagagattcagaatttgtcctccaaagtacgtaccaatcttcgcaaacaagtcgtcgctcagttgactaagaacgaaatctttaaacgcatcgacaaaaaggaactgatccagtctgacctgattgattttgtgaagaatgagccggatgccaatgagaagatcgctctgatttccgaatttcgtaattttacagtgtactttaagggtttccatgagaatcgtcgcaacatgtacagtgacgaagaaaaatctacgtccattgctttccgtttaattcacgagaatctgcctaaattcattgataatatggaagtattcgctaaaattcaaaatacttcaattagcgaaaattttgacgcgattcaaaaagaattatgcccggaactggtgacattatgtgaaatgtttaaacttgggtattttaacaagaccttatctcaaaaacaaattgatgcgtataatacagtcatcggtggaaagactactagcgaaggaaaaaagatcaaagggcttaatgaatatattaacctttataaccaacagcataagcaagagaagcttcccaagatgaaacttctgttcaagcagattttgtcggaccgtgagagcgcttcatggttgccggagaagttcgagaacgactcccaagtagtgggagctatcgtaaacttttggaatactatccatgacacagttcttgcggaaggcgggcttaagaccattatcgcctcccttggttcatatggcttagaagggatctttttaaagaatgacctgcagcttaccgacatctctcaaaaagccacaggaagttggggaaagatctccagtgaaattaaacaaaaaatcgaagtgatgaaccctcaaaaaaaaaaagagtcgtatgagacctatcaggaacgcattgataaaatctttaaatcatataagtcgttttcactggcttttatcaacgagtgtctgcgtggagagtataaaatcgaagattatttcctgaaactgggagccgtgaacagttcctctcttcagaaagagaaccacttctcacacattttgaatacgtatacagatgtaaaggaagtaatcggcttttactcggaaagcacggatacgaaacttatccgcgataacggatctattcaaaagattaaattgtttttagacgcggtaaaagatctgcaggcgtacgtaaagcctttgcttggaaacggggacgagactgggaaagacgaacgtttttacggtgaccttatcgagtactggtcactgttagatctgattactccactgtataatatggtgcgcaactacgtgacacaaaagccttattcggttgataaaatcaagattaactttcagaatccaactttgcttaatggatgggacctgaacaaagagactgataacacgtcagtcatccttcgtcgtgacgggaagtattacttggctatcatgaacaataaatcacgtaaggtcttcttaaagtacccgtcggggacagatcgcaactgctacgaaaaaatggagtacaagttgcttcctggagcgaacaagatgcttccgaaagtcttcttcagtaaatcgcgcattaatgagttcatgccaaatgaacgccttctttccaactacgagaaagggacacataagaagagtggtacctgtttctcgttagacgactgccataccctgattgatttcttcaagaagagtcttgacaagcatgaagactggaaaaattttgggttcaaattttctgatacttccacgtacgaggacatgtctggattctataaagaagtggagaaccaaggctacaagttgtctttcaaaccaattgatgcaacgtatgtagaccaactggttgatgaaggcaaaattttcctgttccagatttataataaagatttctcggaacactctaaggggacccccaatatgcacacgttatattggaagatgttattcgacgagactaaccttggcgacgtggtttataaattgaatggtgaggcggaggtgttctttcgtaaagcaagcatcaacgttagtcacccaactcatcctgcaaacattccaattaagaagaagaatttgaagcacaaggatgaggagcgcattttaaagtacgatcttattaaagataaacgttatacggtcgaccagtttcaatttcatgttccaatcacgatgaattttaaggccgatggtaatggaaacattaaccagaaggcaattgattatcttcgctctgcatcggacacgcacatcattggaattgaccgtggggaacgcaacttgttatatctggtggtgatcgatggtaacggaaaaatttgtgaacagttctcgttgaacgagattgaagtcgaatataacggcgagaagtattcgacgaattaccacgatttgctgaatgtgaaagagaatgaacgcaagcaagcgcgccaaagttggcagtcaattgcgaatatcaaggacttaaaagaaggctatctgtctcaggtaattcataaaatctccgaacttatggttaaatacaacgcgattgtggtcttggaagatttgaatgccgggtttatgcgtgggcgccaaaaggtggaaaagcaggtgtaccaaaagtttgagaaaaaactgatcgaaaaattaaattatttggtattcaagaaacagtcttcagacctgcctggtggacttatgcacgcataccaattagccaacaagtttgaaagttttaacaccctgggtaaacagtctggcttcttgttttatatccctgcctggaatacatcaaagatggatccagtaactggttttgtgaacttatttgatgtaaaatatgaatccgtagataaagcgaagtctttttttagtaagtttgattcaatccgctacaatgttgagcgcgatatgttcgagtggaagttcaactatggtgagttcaccaagaaagcagaaggaaccaagacggactggacggtttgttcctacggcaatcgtatcatcactttccgcaacccagataagaactcgcaatgggataacaaggagatcaatttgacggaaaacattaaattgttatttgagcgtttcggcattgacctgtcgagtaacctgaaagatgaaattatgcagcgtacagaaaaagagttttttattgaattaatctcgttgtttaaacttgtcttacaaatgcgcaacagttggacaggtacggacattgattatttggtatccccagtatgcaacgagaacggggagttttttgactcccgcaacgtcgacgagactttgccgcagaacgccgatgcgaacggcgcctacaatattgctcgtaagggtatgatcttattggataaaattaaaaaatcaaatggtgaaaagaagttagcactgagtatcaccaatcgtgagtggttaagtttcgcacaggggtgctgcaagaacggatga

SEQ ID NO: 885 - DNA, 3738 bp, synthetic construct
  misc_feature 1..3738: note = Description of Artificial Sequence: Synthetic polynucleotide
  source 1..3738: mol_type = other DNA
atggaaacgttctccggatttacaaatttatacccattaagtaagacgttacgttttcgtcttatcccggttggtgagacgttaaaatactttatcggcagcgggatcttggaagaagaccaacatcgcgccgaatcatatgtcaaggtaaaggctattattgacgattaccatcgcgcttatatcgagaactcccttagtggtttcgaacttccccttgagtccacagggaagtttaatagtttggaggaatactacttgtaccataatatccgtaataaaaccgaagaaatccagaaccttagcagcaaggtgcgtaccaacttgcgcaaacaggtagtcgcccaacttactaaaaacgaaatctttaaacgcattgataagaaagagttgattcagagtgatttaatcgattttgtaaagaacgaacccgatgctaatgaaaagattgcccttatttccgaattccgtaattttacagtatattttaagggatttcacgaaaaccgccgcaatatgtactccgacgaggaaaagtcaactagtatcgcgtttcgtttgattcatgaaaacttgcccaaatttattgataacatggaggtttttgcgaagattcaaaacacaagcatttccgagaacttcgatgcgattcaaaaggagctttgcccggaattggtcacattatgtgagatgttcaagctgggctatttcaacaagactttatctcagaagcagatcgacgcttacaatacagtgatcggaggcaaaaccacatcggaaggaaagaaaatcaagggcttgaacgagtatatcaacctgtataaccagcaacataagcaagaaaaacttcccaagatgaaattacttttcaagcaaatcttatctgaccgtgagtcggccagctggcttcctgaaaagtttgaaaacgactcacaagttgtcggtgcaatcgttaatttttggaacaccattcatgatacggtcttagcagaggggggcttaaagactattatcgcttcgttggggtcgtacggtctggaaggtatttttttgaaaaacgatttacaattaacagacatcagccaaaaagccacgggatcctgggggaagatttcaagtgagattaaacagaaaatcgaagtaatgaatccccagaaaaagaaggaatcttatgaaacttaccaggaacgtatcgataagatttttaaatcgtataaaagtttttctttagcttttattaatgaatgccttcgcggtgaatacaagatcgaagactacttccttaagttaggtgcggtcaatagcagttctttacaaaaggagaaccatttctcccacattcttaatacatatacggacgttaaagaagtcattggattttactctgagtcgacagacactaaattgatccgcgacaacggttcgattcaaaaaattaagttattcctggacgccgtgaaggatcttcaagcgtacgtcaagcctctgttggggaatggcgatgaaacgggcaaggatgaacgcttttacggtgatttgatcgagtactggtcgcttcttgatttaattactccactttataatatggtgcgtaattatgtgactcagaaaccctatagcgtagacaaaattaaaatcaatttccaaaaccctacgcttctgaacgggtgggacttgaataaagaaacagacaacacttcagtcattttgcgccgtgatgggaagtactatttagcgatcatgaacaacaagtcccgcaaggtatttcttaaatacccgtcgggaacggaccgtaattgttatgaaaagatggagtacaaactgttaccaggggcaaataagatgttacctaaagtattcttcagtaagtcgcgcatcaatgagtttatgcccaatgaacgccttttgagcaactacgaaaaagggacgcataaaaagtccggtacttgcttcagtttggatgattgtcacactttgatcgactttttcaagaagtcgctggataagcatgaagattggaagaacttcggctttaaattctccgatacgtctacttatgaggacatgtcggggttttacaaggaggtggagaatcaagggtacaagttatcatttaagcctatcgatgccacgtacgttgatcagttagtagatgaaggtaaaatttttttgtttcaaatctataacaaagatttctcagaacactcgaagggcactcccaatatgcacactctttattggaagatgctgtttgacgaaacgaatttgggtgacgtggtttataagcttaacggcgaggcggaagtgttctttcgtaaggcaagtattaacgtctctcacccaacccacccggcaaatattccgatcaaaaagaaaaatctgaagcacaaagacgaggagcgcatcttaaaatacgatcttatcaaggataaacgttacacggtagaccagttccagttccacgtaccgatcacaatgaacttcaaggcagatggaaacgggaacatcaatcagaaagcgatcgattacttgcgcagcgcgtcagatacacatattattgggattgatcgtggtgaacgcaacctgctgtatcttgttgtcattgatggcaacgggaaaatttgtgaacagttttctttgaacgagattgaggtggagtataacggagagaagtatagcaccaattaccatgatttgttgaacgtgaaagaaaatgaacgtaaacaggcgcgccagtcttggcagtccatcgccaatattaaagacttgaaagaaggctacttatcacaagtaatccacaaaattagcgaattaatggtaaaatataatgccatcgttgtcttagaggacttaaacgcaggattcatgcgtggccgccaaaaggtcgagaagcaggtgtaccaaaaatttgagaaaaaactgatcgagaagctgaactacttagtttttaagaaacaatcgagcgatttaccaggcggcttgatgcacgcatatcagttggcaaataagttcgaaagctttaatactcttgggaaacaatcgggctttctgttttatatccccgcatggaacacgtcaaaaatggaccctgtgacagggttcgtgaatttatttgatgttaagtacgaatcagtcgataaagcgaaaagctttttctccaaattcgatagtatccgctacaacgtcgagcgcgacatgtttgaatggaagttcaattacggggagtttaccaagaaagccgaaggcaccaagacagattggactgtgtgctcctatgggaaccgcattatcaccttccgtaatcccgacaagaactctcaatgggataacaaggagatcaacttgaccgaaaatattaaactgctttttgaacgttttggaatcgaccttagttccaaccttaaggatgaaattatgcagcgtacagaaaaggaatttttcatcgagctgatctccctttttaaacttgtccttcagatgcgcaactcatggactgggacggacatcgattacctggtttcccccgtttgtaacgagaacggcgagttctttgattctcgcaacgtcgacgagacgctgcctcagaacgcagatgcgaacggggcctataatattgcacgtaagggcatgattctgctggacaagattaagaagagtaatggggaaaaaaagttagcactttccatcacgaatcgcgaatggttatcctttgctcagggttgctgcaaaaatggatga

SEQ ID NO: 886 - DNA, 3738 bp, Phocaeicola plebeius
  source 1..3738: mol_type = genomic DNA
atggaaacattttctggatttacaaatttgtatcctttgtcaaagacattgcggtttagattgattcctgtaggggaaacattgaaacattttattgatagtggaatattggaagaagaccagcatagggctgagagttatgtgaaggtaaaggctattattgatgactatcatagagcttatattgagaattctttatcaggctttgaattacctttggaaagtacgggtaaattcaattctttggaggaatattatttgtatcataatattcgcaataaaacggaagaaattcagaacttgtcatccaaggtcagaactaatctgaggaaacaagtcgtggttcaactaactaagaacgaaatatttaaaagaattgataaaaaagagctgattcagagtgatttgattgattttgttaaaaatgagcctgatgcaaatgagaaaatagcactaatctcagaatttcgtaattttactgtatacttcaaaggttttcatgaaaaccgtagaaatatgtattccgatgaagaaaagtccacgtctatagcctttcgtctgattcatgagaatcttcccaagtttattgataatatggaagtgtttgcaaaaatacagaatacttctatctcggagaattttgatgctatacagaaagaactttgcccggagttggtaaccctttgtgaaatgtttaagttggggtattttaataagactttaagtcagaaacaaatagatgcttataatactgttataggtggtaaaaccacatcagaaggtaaaaagattaaaggtcttaatgaatatattaatctttataaccagcagcataagcaagagaaattacccaagatgaagcttcttttcaagcagatacttagtgatagagaaagtgcgtcatggctgccagagaagtttgagaatgatagtcaggttgtcggtgcaatggtgaatttctggaatactattcatgatacagttcttgcagaaggaggattgaaaacgattattgcttcattgggtagttatggccttgaaggtattttcctaaagaatgatttacaacttactgatatatcacaaaaggcaacaggtagttggagtaaaatatcttctgagataaagcaaaaaatagaggtgatgaatcctcaaaagaaaaaagagtcttatgagagttatcaagaacgtatagataagctattcaagtcttataaaagtttttctttagcttttataaatgagtgccttcgtggtgagtataagattgaagattattttctcaagttaggggctgtgaatagcagttcgttacagaaagaaaatcatttttcgcatattctcaatgcatatacagatgtaaaagaggcgattggcttttactctgaatcgactgacaccaaattaatacaagataatgattccattcaaaagataaaacagttccttgacgcagttaaagacttacaggcttatgtaaaaccattattgggtaatggtgatgaaaccggtaaggatgaaaggttttatggcgatttgattgagtattggagtctgcttgacttgattactcctttatataatatggttcgtaattatgtcactcagaagccgtattctgtagataaaataaaaataaatttccagaatcctactttattgaatggttgggaccttaataaagaaacggataatacatctgtaatattgcgtcgtgatggcaaatattatctggccataatgaataacaaatccagaaaagtctttttgaaatatccatcagggacagatggaaattgctatgagaagatggagtataaacttttaccaggtgctaataagatgctacctaaggtcttcttttcaaaatcaaggataaatgaattcatgcctaatgagcgtttgttgtcaaattatgaaaagggcacgcataaaaagtcgggtatttgttttagtttggatgattgtcatactttgatagatttctttaagaagtctttggacaaacatgaggattggaaaaactttggcttcaagttctctgatacttctacatatgaagatatgagtggtttttataaagaagtagagaatcaaggttataaattatcctttaagccgattgatgctacgtatgtggatcagcttgttgatgaaggtaagatttttctgtttcagatttataacaaggatttttctgagcatagcaaaggtacgcctaatatgcataccttgtattggaaaatgttgtttgatgaaacaaatcttggggatgtggtatataaactaaatggtgaggctgaagtctttttccgtaaggcaagtataaatgtatcacatccaactcatccggctaacatacccataaagaaaaagaatcttaaacataaagatgaagaaagaattcttaaatatgacttgattaaagataagcgttataccgtcgaccagttccagtttcatgtgccaataaccatgaatttcaaggcggatggaaatggaaatataaaccagaaagcgatagactatttatgttcggcatcagatactcatataatagggattgaccgtggtgaacgaaacttgttatatcttgtagtgattgatggaaatggaaaaatctgtgagcaattctctttaaatgaaatagaagttgaatataatggtgaaaagtattcaacaaattaccatgatttgcttaatgtcaaggagaatgaaagaaagcaggcaagacagagctggcaaagtatagctaacataaaagacttgaaagaaggctatttaagtcaggttattcataagatttctgaattgatggtcaaatataatgcgattgtggtgcttgaggatttgaacgctggatttatgcgtggccgacaaaaggttgaaaagcaggtttatcagaaatttgaaaagaaactcattgagaagttaaattatctcgtattcaagaaacagtcttctgatttgcctggtgggcttatgcatgcttatcagttagctaataaatttgagagttttaatgctttaggtaaacaaagcggatttctcttttatatccccgcctggaataccagtaaaatggatccggtaacaggttttgtaaatttgtttgatgtgaagtatgaaagtgttgataaggcaaaaagttttttcagtaagttcgattctatgaggtataatgtggaaagagatatgtttgaatggaaattcaattatggtgaattcacgaaaaaagccgaaggaactaaaactgattggactgtttgttcctacggtaatagaattatcacctttagaaatccggataaaaattctcaatgggataataaagaaataaatcttaccgaaaatattaagctgctgtttgaaaggtttggtatcgacttatcttcaaatctgaaagatgagataatgcaacgtacagaaaaagaattctttatcgaacttatatccctatttaagcttgtgttacagatgcgtaatagttggacaggtactgatatagattatctggtatcacctgtatgcaatgaaaacggtgaattttttgatagcagaaacgtagatgaaacacttccgcaaaatgcggacgcaaacggagcatataacattgcaagaaaaggaatgatacttcttgataagattaagaaaagtaacggtgagaagaagcttgctctatctataactaatagagaatggctttcatttgctcaaggttgttgcaaaaatggatga

SEQ ID NO: 887 - DNA, 3738 bp, synthetic construct
  misc_feature 1..3738: note = Description of Artificial Sequence: Synthetic polynucleotide
  source 1..3738: mol_type = other DNA
atggaaacgtttagtgggttcacgaatctttacccgttatccaaaacgttgcgttttcgccttatcccagtaggggagacgttaaaacattttatcgattcgggcatcctggaggaagatcaacaccgcgccgagtcatacgtcaaggtgaaagcgattattgacgactaccaccgtgcatacattgaaaattcactttctggcttcgaattaccccttgaatctaccgggaaatttaactcccttgaggagtactatttatatcacaacattcgtaacaaaacagaagaaattcaaaatttgtcttccaaagtacgcaccaaccttcgtaaacaggttgtggtccaattgacgaaaaacgaaatcttcaaacgcatcgacaagaaagaattgatccagagcgacctgatcgattttgttaaaaacgaacccgatgctaacgagaagattgcactgatttctgagttccgcaattttacagtttacttcaaaggcttccacgaaaaccgtcgtaacatgtactccgatgaagagaaatcgacatccatcgcgttccgcttgatccacgaaaatttaccgaaattcattgataatatggaggtattcgcaaagattcaaaatacgtccatttcagaaaacttcgatgcaatccaaaaggagctgtgccccgaattggttaccctgtgtgaaatgtttaagttaggttattttaataagaccttgtcgcaaaaacaaatcgacgcctacaacactgttattggtggaaagacaacgtcggagggaaagaaaattaaggggttgaatgagtatattaatctttataatcaacaacacaagcaggagaagttaccaaagatgaaattgcttttcaaacaaatcctttctgaccgtgaaagtgcaagctggcttcccgagaaatttgaaaacgactcccaggtagtgggtgctatggtaaatttttggaataccatccacgacaccgtgttggctgaaggtggccttaaaactatcatcgcaagtcttgggtcgtatgggctggagggtatcttcttgaagaacgatcttcagcttacagacatttcccagaaagcaacaggttcctggagcaagatctcttcggaaattaagcaaaagatcgaggtcatgaacccacagaaaaaaaaggaatcctacgagagttatcaagaacgtatcgataaactgtttaaaagctataaaagtttttcgctggccttcatcaacgagtgcctgcgtggtgagtataaaatcgaagactactttctgaaattgggtgctgtcaatagttcatcgctgcaaaaagagaatcacttcagtcacattttaaacgcctatacagatgtcaaagaggcgattggtttttacagtgagagtacagataccaaattgattcaggacaacgatagcatccaaaagatcaagcaattcttggatgccgtcaaggacttgcaagcgtacgtaaagccgcttcttggcaacggcgacgagacaggcaaagatgagcgcttctatggtgatttgattgaatattggtctctgttagacttaatcacaccgctgtataatatggtgcgtaattacgttacccagaagccttactccgtagataaaattaaaatcaactttcagaatcccacccttcttaacggatgggacctgaataaagaaaccgacaatactagtgttattctgcgtcgtgacggcaaatattatttggcaattatgaataacaaatcgcgtaaggtatttttgaaatacccttccggaactgatggaaactgttatgagaagatggaatataaattgttacccggtgccaacaagatgcttccaaaagtttttttttctaaatcccgcatcaacgagttcatgccgaacgaacgtcttctgagtaactacgaaaaagggacgcataaaaagtcaggtatttgtttctcgctggatgactgtcacacccttatcgacttttttaagaagagcttagataagcacgaagattggaaaaattttggtttcaagttttcagacacatctacttacgaagatatgtcaggtttctacaaagaagtagagaatcagggctataagttatcgttcaagcccatcgatgcaacctacgtggatcagcttgttgatgaagggaagatttttttgtttcaaatctacaacaaagatttctcagagcactcaaaaggaaccccgaatatgcacacattatattggaaaatgttatttgatgagacgaacctgggggacgtagtatacaaacttaacggtgaagccgaagttttctttcgtaaagctagcattaacgtttcgcaccctactcacccagcaaatattccgatcaagaagaagaatctgaaacacaaggacgaagaacgcattttgaaatatgacctgatcaaagacaagcgctacacagtcgatcagtttcaatttcacgttccaatcaccatgaattttaaggccgacggtaatgggaatattaaccagaaggctatcgactacctttgttcggctagcgacacacacattattgggattgaccgcggggaacgcaatcttttgtaccttgttgttatcgacggtaacgggaaaatctgtgagcaattctctcttaatgagatcgaagtagaatataatggagaaaagtatagcacgaactaccatgacctgttaaatgtgaaagaaaatgagcgcaagcaggcacgccaatcgtggcagagtattgcaaacattaaagatctgaaggagggctacctttcacaagtcatccacaaaatctctgagttgatggtgaaatacaatgcgattgtagtattggaagaccttaatgctggatttatgcgtggacgccagaaggtggaaaagcaagtttaccaaaagttcgagaagaaacttattgagaagctgaactacctggttttcaagaagcagtccagcgacttgcccggtggtctgatgcatgcatatcagcttgcgaataagtttgagagcttcaatgcattgggaaagcagtcaggctttctgttttacatccctgcttggaatacatcaaaaatggatcccgtgactgggttcgtcaacttattcgatgtaaagtatgagtcggtagacaaagctaagagcttcttttcaaaattcgatagcatgcgttataatgttgagcgtgacatgttcgagtggaagtttaattatggggaatttaccaagaaagctgaaggtacgaaaaccgactggactgtgtgctcgtatgggaatcgtattatcaccttccgtaacccagataagaactcgcagtgggataacaaagaaatcaatctgacggaaaacatcaaacttttattcgaacgtttcgggattgacctgtctagcaacctgaaggacgaaatcatgcaacgcactgaaaaggaattcttcattgagttgatttcgttatttaagcttgtattgcagatgcgcaacagttggacgggcaccgacatcgattacttggtatctccagtttgtaatgaaaatggcgagttttttgacagtcgtaatgttgatgagactttaccccagaacgctgatgccaacggggcttataatatcgcacgcaaggggatgatcctgttggataaaatcaagaaaagcaatggtgaaaaaaagttagcgctgtcgattaccaatcgtgaatggctgagctttgctcaaggttgctgtaagaatggctga

SEQ ID NO: 888 - DNA, 3738 bp, synthetic construct
  misc_feature 1..3738: note = Description of Artificial Sequence: Synthetic polynucleotide
  source 1..3738: mol_type = other DNA
atggaaacgttctcaggtttcaccaacttatatccattgtcaaaaactcttcgctttcgcctgatccccgtcggggagacgttaaagcacttcatcgactctggaattttggaagaggaccaacatcgtgctgagtcttacgtaaaagtgaaggctattatcgatgattaccaccgtgcatacatcgaaaatagtttatctgggttcgaactgccattggaatcgacaggcaaatttaacagcttagaagaatactacttatatcacaacatccgtaataaaacagaagagattcagaacctttcctcgaaggtgcgcacgaacttacgcaaacaagtcgtcgttcaattaaccaagaatgaaatctttaagcgtattgataaaaaagagttaattcaatctgatctgattgattttgttaaaaacgagcctgacgcgaacgaaaagattgcgttgatttcggaatttcgtaattttacagtttatttcaaagggtttcacgagaaccgccgcaatatgtactcagacgaggagaagtcaacatccatcgcgttccgtctgatccacgaaaatttgcccaaatttattgacaacatggaggtctttgctaagatccagaatacgtccattagtgagaactttgacgccattcagaaggaactttgtcctgagttggtaaccttatgtgaaatgtttaaattggggtactttaacaaaactctttctcaaaagcagatcgatgcttataatacagttatcggtggcaagacaacctccgaaggcaaaaagatcaagggattgaacgaatatattaacctttataaccagcagcacaaacaggaaaaactgccgaaaatgaaactgttgtttaagcaaattttatcagaccgtgagtccgctagctggttgccggaaaagtttgaaaacgactcgcaggtcgtaggggctatggtaaatttctggaatacaatccatgataccgtccttgcagaaggtgggttaaaaacgatcatcgctagtcttggctcctacggcttggaaggtatcttcttaaaaaacgatcttcagctgaccgacatctcacaaaaggccactgggtcatggtctaaaatttcgagcgagatcaaacaaaaaatcgaggtaatgaacccgcagaaaaagaaggagagttatgagagctaccaggaacgcatcgataaactgtttaagagctataaaagcttttcgcttgcttttattaacgagtgtttacgtggcgaatataagatcgaagattactttctgaagcttggagcggtaaacagtagtagcctgcaaaaagaaaaccatttctcccacattcttaatgcatacacagatgtaaaagaagctatcggattctactccgagtcaaccgacacgaaattgattcaagataatgactcgatccagaagattaaacaatttctggatgcggtaaaggacttacaggcatacgttaaaccactgcttggcaacggcgacgaaacgggaaaagatgagcgtttctatggggacttaattgagtattggtcattactggatttaatcaccccactttacaatatggtgcgtaactatgtgacacaaaagccatattctgtggacaaaatcaagatcaactttcagaaccctactcttctgaatggctgggatcttaacaaagaaacggacaatacgagtgtgattctgcgtcgcgatggaaaatattatcttgcaatcatgaataacaaatctcgcaaggtgtttttgaaatacccatcgggcacagacggaaactgctatgaaaagatggagtataaactgcttcccggggccaacaagatgcttcccaaagtatttttctcaaaatcccgtatcaatgagtttatgcctaatgagcgtcttttgtccaactacgagaagggtacccataagaaaagtggaatctgctttagtttggacgattgtcatacattaatcgatttcttcaagaaaagcttagacaaacacgaggattggaaaaattttggtttcaaattcagcgatacctccacgtacgaagatatgtcgggtttttataaggaagttgagaatcaaggatacaagttatctttcaagcctattgacgcaacgtatgtcgaccaattagttgacgaaggaaagatttttcttttccaaatttataacaaagacttctctgagcactcgaagggtacgccaaacatgcatacactttactggaaaatgcttttcgacgagacgaatttaggagacgttgtctataagcttaatggggaggcagaagtatttttccgcaaagccagcatcaacgtttcgcacccaacccatcctgccaacattcctatcaagaagaaaaaccttaaacacaaagacgaggaacgcattttaaagtatgacctgattaaagataaacgctatactgtggatcaattccagttccacgtgcctattacaatgaatttcaaagcagacggtaacggcaacattaatcaaaaagccattgactatttgtgcagcgcatcagacacacacatcattggtattgatcgtggggagcgcaatttactgtacttagtagtgattgatgggaatggcaaaatctgcgagcaattctcgttgaacgaaattgaagtcgagtataatggagaaaaatactctaccaactaccacgacttactgaacgttaaagagaacgagcgtaaacaagctcgccagtcttggcagtcaattgcgaacattaaggatttgaaagaaggctatctttcacaagtaattcataaaatcagtgaactgatggtaaaatacaatgctattgttgtattggaagacttaaatgccgggtttatgcgtggccgtcagaaagtcgaaaaacaagtctaccaaaaattcgaaaaaaaattaattgaaaaattgaattacctggtattcaaaaagcagtccagtgaccttcccggcggattaatgcacgcctaccaattagcaaacaaatttgagagctttaacgcacttggaaaacagagtggtttccttttctacatcccagcgtggaatacaagcaagatggatcctgtaacgggatttgttaatttgtttgacgtcaagtacgagtccgtggataaggctaaaagtttcttctcgaaattcgattcaatgcgttacaacgttgaacgcgatatgttcgagtggaagtttaactacggcgagttcacgaaaaaagccgaaggaacaaaaacggactggacggtatgctcgtatggaaaccgcatcatcactttccgtaatcccgacaagaatagtcagtgggataataaggaaatcaacttaactgaaaatatcaaacttctgtttgagcgcttcggaatcgacctgagctctaacttaaaagatgagattatgcaacgtaccgaaaaggaattctttattgagttgattagcttgtttaaattggtacttcagatgcgtaacagctggacaggcaccgatattgattacttagtaagccctgtctgcaacgagaatggagaattctttgatagccgcaatgttgacgaaacacttccgcaaaatgcggatgcgaacggagcatataatatcgctcgcaaaggcatgatccttctggacaaaattaaaaagtccaatggggaaaaaaaattggctttatctattacaaatcgcgaatggctttcctttgcccaaggttgttgtaagaacggctga

SEQ ID NO: 889 - DNA, 3738 bp, synthetic construct
  misc_feature 1..3738: note = Description of Artificial Sequence: Synthetic polynucleotide
  source 1..3738: mol_type = other DNA
atggagaccttctcgggttttactaacctgtacccccttagtaagacgttacgtttccgtctgatcccagtgggggaaacgttgaagcattttattgactccgggattcttgaggaagaccaacatcgtgccgaaagttacgtgaaagttaaggccattatcgacgattatcaccgtgcttacatcgagaacagcctttcaggcttcgagttgcccttagaatctacaggtaaattcaactctttagaagaatattacctttaccacaatatccgtaataagacagaagaaatccagaatctgagttcaaaggtacgcacaaacctgcgcaaacaggttgttgtgcagttaactaagaacgagatctttaaacgtatcgacaagaaagaattaatccagagcgatctgatcgattttgtgaagaatgaacccgatgctaatgaaaagattgctcttatcagcgagtttcgtaacttcaccgtgtatttcaaggggtttcacgaaaaccgtcgcaacatgtactcggatgaagaaaagagcacatcaattgctttccgtctgatccatgagaatcttccaaaattcatcgacaatatggaggtatttgcgaagatccaaaatacttccattagcgaaaacttcgatgctatccagaaagaattatgccccgagttagtcacgctttgcgaaatgttcaaacttggctactttaacaagacactttcacagaaacaaattgatgcttacaatacagtcatcgggggaaagactacttcagaaggtaagaagattaagggtctgaacgagtacatcaatttatataaccaacaacacaaacaagaaaagcttccgaagatgaaattattatttaaacaaatcctttcggatcgtgagtcggcgtcgtggctgcctgaaaaatttgaaaacgactcccaagtcgtcggggctatggttaatttctggaataccattcacgatactgtccttgccgaaggcggtcttaagacgattatcgcttcgcttggaagctacggtttagagggtatctttctgaagaatgacttgcaacttacagacatttctcaaaaagcgactggatcgtggtccaaaatctcatcagagatcaagcagaaaatcgaagtgatgaatccacagaaaaaaaaggaatcctatgaatcttaccaagaacgcatcgataagctgtttaagagttacaagtcgttttctcttgccttcattaatgaatgtctgcgtggcgaatataagattgaagattatttcttgaagttgggtgcagtgaacagctcttcactgcaaaaagaaaaccactttagtcacattctgaatgcttatactgacgtaaaggaggctatcggattctatagtgaaagcactgacacgaaattaattcaggataacgacagcatccaaaaaatcaaacaatttcttgacgcagtaaaggatttgcaagcttacgttaagcccttgcttgggaatggggatgaaactggtaaggatgaacgcttctacggcgaccttattgagtactggtcgttgcttgatctgattacaccactgtacaacatggttcgcaattatgtaacccaaaagccatattcagttgacaagattaagatcaattttcaaaaccccactctgcttaatggctgggacttgaataaggaaaccgataatacgtcagtgattctgcgccgtgatggcaaatattatttagccatcatgaacaacaagtcacgcaaagtttttcttaagtaccccagtgggacggatggtaattgctacgagaaaatggagtataagctgttgcctggagccaataaaatgctgccaaaagtatttttcagcaaatcgcgcattaatgaatttatgcccaacgagcgcctgttatcgaattacgaaaagggtacacacaaaaagtcggggatttgtttcagcttagatgattgtcacacattgatcgattttttcaaaaaaagtttagataaacacgaagattggaagaatttcggctttaaattctcggatacctcaacgtacgaggacatgtcagggttttataaagaagtcgaaaaccagggatataagttgtcattcaaacctatcgacgcaacgtatgtcgaccagcttgtggacgagggaaagatcttcttgttccaaatttataacaaagatttcagcgagcatagtaaaggaactccgaacatgcacacgctgtactggaaaatgttatttgacgaaacaaatttaggcgatgtcgtgtataaattaaatggtgaggcggaagttttcttccgcaaggctagcatcaacgttagtcatcccacacatccggcaaatattccgatcaaaaaaaaaaacttgaagcataaggatgaagaacgtatccttaaatacgatctgattaaggataaacgttatacggtggatcaatttcagttccatgtgcctattacgatgaactttaaagctgacgggaacggcaatattaaccagaaagccattgactatttatgtagtgcttccgacacgcacattatcggtattgaccgcggagagcgtaaccttctgtacttagttgtcattgacgggaacggaaagatctgcgaacaattctcattgaacgaaatcgaggtggaatacaatggggaaaaatacagcacaaactaccacgatcttttaaacgtcaaagagaacgagcgcaaacaagctcgtcagagctggcagtctattgccaatattaaagacttaaaggagggatacctgtcgcaagtcattcataaaatcagtgaacttatggttaagtacaatgcgattgtagtccttgaagacctgaacgctgggttcatgcgcggacgtcaaaaagttgagaaacaggtatatcagaagttcgagaaaaagttaattgagaagctgaattacctggtcttcaagaagcagtcgtcggatctgccgggagggctgatgcacgcttaccagctggctaataaattcgagtctttcaacgcattaggcaaacaaagcggattcttattttacatcccagcttggaatactagcaaaatggatccagtcacaggctttgtgaatttatttgacgtaaaatacgagtctgtagataaggctaagtcgtttttcagcaaattcgacagtatgcgttacaacgtcgaacgcgacatgttcgagtggaaatttaactacggggaattcacgaaaaaggccgagggaactaaaacggattggacagtctgctcctacggtaatcgtatcatcacttttcgtaacccggacaagaattcccagtgggacaacaaagaaatcaacttaactgagaacatcaaattgcttttcgagcgctttgggatcgatttgtcctccaaccttaaagatgagattatgcaacgcacggaaaaggagttcttcatcgagctgatcagtcttttcaaattagtgcttcaaatgcgtaacagctggaccggtacggatattgactaccttgtgtcccctgtgtgtaacgagaacggagaattttttgactcgcgtaacgtcgacgaaaccttgccacaaaatgccgacgccaacggtgcttacaatattgctcgtaagggcatgattcttcttgataagatcaaaaagagtaatggagagaaaaaattggcattatcaattacaaatcgcgagtggctgtcttttgcacaagggtgttgtaaaaatggatga

SEQ ID NO: 890 - DNA, 3738 bp, Phocaeicola plebeius
  source 1..3738: mol_type = genomic DNA
atggaaacattttctgggtttacaaatttgtaccctttgtcaaagacattgcggtttagattgattcctgtaggggaaacattgaaacattttattggtagtggaatattggaagaagaccagcatagggctgagagttatgtgaaggtaaaggctattattgatgactatcatagaacttatattgagaattctttatcaggctttgaattacctttggaaagtacgggtaaattcaattctttggaggaatattatttgtatcataatattcgaaataaaacggaagaaattcagaacttgtcatccaaggtcagaactaatctgaggaaacaagtcgtgactcaactaactaagaacgaaatatttaaaagaattgataaaaaagagctgattcagagtgatttgattgattttgttaaaaatgaacctgatgcaaatgagaaaatagcactaatctcagaatttcgtaattttactgtatacttcaaaggttttcatgaaaaccgtagaaatatgtattcagatgaagaaaagtccacgtctatagcctttcgtctgattcatgagaatcttcccaagtttattgataatatggaagtgtttgcaaaaatacagaatacttctatctcggagaattttgatgctatacagaaagaactttgcccggagttggtaaccctttgtgaaatgtttaagttggggtattttaataagactttaagtcagaaacaaatagatgcttataatactgttataggtggtaaaaccacatcagaaggtaaaaagattaaaggtcttaatgaatatattaatctttataaccaacagcataagcaagagaaattacccaagatgaagcttcttttcaagcagatacttagtgatagagaaagtgcgtcatggctgctagagaagtttgagaatgatagtcaggttgtcggtgcaatggtgaatttctggaatactattcatgatacagttcttgcagaaggaggattgaaaacgattattgcttcattgggtagctatggccttgaaggtattttcctaaagaatgatttacaacttactgatatatcacaaaaggcaacaggtagttggagtaaaatatcttctgagataaagcaaaaaatagaggcgatgaatccccaaaagaaaaaagagtcttatgagagttatcaagaacgtatagataagctattcaagtcttataaaagtttttctttagcttttgtaaacgagtgccttcgtggtgagtataagattgaagattattttcttaagttaggggctgtgaatagcagtttgttacagaaagaaaatcatttttcgcatattctcaatacatatacagatgtaaaagaggtgattggcttttactctgaatcgactgatactaaattaatacaagataatgattccattcaaaagataaaacagttccttgacgcagttaaagacttacaggcttatgtaaaaccattattgggtaatagtgatgaaaccggtaaggatgaaagattttatggtgatttgattgagtattggagtctgcttgacttgattactcctttatataatatggttcgtaattatgtcactcagaagccgtattctgtagataaaataaaaataaatttccagaatcctactttattgaatggttgggaccttaataaagaaatggataatacatctgtgatattgcgtcgtgatggtaaatattatctggccataatgaataacaaatccagaaaagtctttttgaaatatccatcagggacagatagaaattgctatgagaagatggagtataaacttttacctggtgctaataagatgttacctaaggtcttcttttcaaaatcaaggataaatgaattcatgcctaatgagcgtttgttgtcaaattatgaaaagggcacgcataaaaagtcgggtacttgttttagtttggatgattgtcatactttgatagatttctttaaaaagtctttgaacaaacatgaggattggaagaattttggcttcaagttctctgatacttctacttatgaagatatgagtggtttttataaagaagtagagaatcaaggttataaattatcctttaaaccgattgatgctacgtatgtggatcagcttgttgatgaaggtaagatttttctgtttcagatttataacaaggatttttctgagcatagcaaaggtacgcctaatatgcataccttgtattggaaaatgttgtttgatgaaacaaatcttggggatgtggtatataaactaaatggtgaggctgaagtctttttccgtaaggcaagtataaatgtatcacatcccactcatccggctaacatacccataaagaaaaagaatcttaaacataaagatgaagaaagaattcttaaatatgacttgattaaagataagcgttatactgtcgaccagttccagtttcatgtaccaataaccatgaatttcaaggcgaatggaaatggaaatataaaccagaaagcgatagactatttacgttcggcatcagatactcatataatagggattgaccgtggtgaacgaaacttgttatatcttgtagtgattgatggaaatggaaaaatctgtgagcaattctctttaaatgaaatagaagttgaatataatggtgaaaagtattcaacaaattaccatgatttgcttaatgtcaaggagaatgaaagaaaacaggcaagacagagctggcaaagtatagctaacataaaagacttgaaagaaggctatttaagtcaggttattcataagatttctgaattgatggtcaaatataatgcgattgtggtgcttgaggatttgaatgctggatttatgcgtggccgacaaaaggttgaaaagcaggtttatcagaaatttgaaaagaaactcattgagaagttaaattatctcgtattcaagaaacagtcttctgatttgcctggtgggcttatgcatgcttatcagttagcgaataaatttgagagttttaatactttaggtaaacaaagcggatttctcttttatatccccgcctggaataccagtaaaatggatccggtaacaggttttgtaaatttgtttgatgtgaagtatgaaagtgttgataaagcaaaaagttttttcagtaagttcgattctataaggtataatgtggaaagagatatgtttgaatggaaattcaattatgatgaattcacgaaaaaagccgagggaaccaaaactgattggactgtttgttcctacggtaatcgaattatcacttttagaaatccggataaaaattctcaatgggataataaagaaataaatcttaccgaaaatattaagctgctgtttgaaaggtttggcatcgacttatcttcaaatctgaaagatgagataatggaacgtacagaaaaagaattctttatcgaactgatatccctatttaagcttgtgctacagatgcgtaatagttggacaggtactgatatagattatctggtatcacctgtatgcaatgaaaatggtgaatttttcgatagcagaaatgtagatgaaacacttccgcaaaatgcagacgcaaacggagcatataacattgcaagaaaaggaatgatacttcttgataagattaagaaaaataacggtgagaagaagcttactctgtctataactaatagagaatggctttcatttgctcaaggttgttgcaaaaatggatga

SEQ ID NO: 891 - DNA, 3738 bp, synthetic construct
  misc_feature 1..3738: note = Description of Artificial Sequence: Synthetic polynucleotide
  source 1..3738: mol_type = other DNA
atggaaacatttagcggctttacgaatttgtaccctttatctaaaacgctgcgttttcgtttaatccccgtgggtgaaacgcttaaacacttcattggtagtggaattttggaggaggatcaacaccgcgcggaaagctacgtcaaagttaaagcgattatcgatgactatcaccgtacttacattgagaattccttatccgggtttgagttgcctctggagagcactggaaagtttaactctcttgaagagtactacctgtaccataatatccgtaacaaaacggaagagattcagaatctgtcctcaaaggtccgtacaaacttgcgtaaacaagttgtgacacagcttaccaaaaacgaaatttttaaacgtatcgataagaaggagttgattcaatcggatcttattgactttgtaaagaatgaacccgatgcgaacgagaaaattgcccttatctccgagttccgcaacttcacagtttacttcaaggggttccatgaaaatcgtcgtaatatgtattcagatgaagagaaatctacgtcaatcgcctttcgtttgatccacgaaaatttacctaaattcatcgataacatggaagtatttgctaagatccaaaacacgtcaatttcagagaatttcgacgctattcagaaggaattatgtccagaattagttactctgtgtgagatgtttaagttggggtatttcaacaagactttgtcgcagaaacagatcgatgcatacaatacggtcatcggaggcaaaactacgtcggaaggcaagaaaatcaagggtcttaacgaatacattaacttgtacaaccagcagcataaacaggaaaagttaccgaaaatgaagctgttattcaaacagatcttgtctgaccgtgaatctgctagctggttgttagaaaagtttgagaacgattctcaagtggtcggcgcgatggttaacttttggaatacaatccatgatactgtgctggcagaaggcggtttgaaaacaattattgcatcattgggctcttatggacttgaaggcattttcttaaaaaatgacctgcagttaaccgatatttcgcaaaaagctacaggaagctggtcaaaaatctcaagtgaaattaagcaaaaaatcgaagcgatgaatccacagaagaaaaaggagtcctacgaaagctaccaggagcgtatcgataaacttttcaagagctataagtccttctcgttggcattcgtgaatgagtgtctgcgtggagaatataaaatcgaagactattttctgaagttgggcgctgtgaatagtagtcttttgcaaaaagagaatcatttttcgcacattttaaatacgtacacagatgttaaggaagtaattggtttctactccgagtctactgacacaaagcttattcaggataacgatagcatccaaaagattaaacaatttttagacgctgtgaaggaccttcaggcatatgttaagcccctgcttggaaatagtgacgagacgggtaaagatgagcgtttttatggagatctgattgagtattggagccttttagatctgatcacacccttgtataacatggtacgtaactatgttacgcagaagccgtattccgtcgacaaaatcaagattaactttcaaaacccaacacttttaaacggatgggacttaaataaagaaatggataacactagcgtcatcttgcgtcgcgacgggaagtactacttggccattatgaataacaaatcgcgcaaagtatttcttaaatatccatctgggactgatcgtaattgttatgaaaagatggaatataaactgttgcccggggccaacaagatgttaccaaaagtgttttttagcaagtcccgcatcaatgagtttatgccgaatgagcgcctgcttagcaattacgagaagggcacgcataagaagtctggaacttgcttctcgttggacgactgccacactctgatcgactttttcaagaagtctttaaataagcatgaagactggaaaaactttgggtttaagttctccgacacctctacgtacgaagatatgtccggcttttacaaagaagttgaaaatcaaggctataagctttcgtttaaaccgattgatgccacgtatgtagatcaattggttgatgaaggaaagatctttctttttcagatctacaacaaggatttttccgagcatagcaaagggactccgaatatgcatacgttatactggaaaatgttgtttgacgagacaaatctgggggatgtggtatataaattaaacggtgaagccgaggtattcttccgcaaggcgtctatcaatgtatcacatccaacgcatcctgcaaacatcccgattaaaaaaaaaaatttgaagcacaaagacgaggaacgcatcttaaaatacgacttaattaaagacaaacgctacacagttgaccaattccaatttcacgtgccaatcacgatgaatttcaaagcgaatgggaatggtaatatcaatcagaaggcgatcgattatttgcgttcggcctccgatacccacattattggaattgatcgtggggagcgcaatttgttatatctggtcgtgattgacggaaatggaaaaatctgtgagcagttttccctgaacgagatcgaggtggaatacaacggcgagaaatatagtacgaactatcacgatttactgaacgtgaaggagaacgaacgcaagcaggcccgccaatcctggcaatccatcgccaatatcaaagacctgaaagaggggtatctttcgcaggtgattcacaagatttcggagttgatggtaaaatacaacgctatcgttgtgctggaagatctgaacgcgggttttatgcgtgggcgccagaaagtggaaaagcaggtgtatcagaaattcgagaaaaagcttatcgaaaagctgaattatttggtatttaagaaacagtcctcggaccttcctggcggtttaatgcatgcctaccaattggcgaataagttcgaatccttcaacactcttggaaagcagagcggatttttgttttacatcccggcttggaatacgtccaagatggatcccgtaacaggtttcgtgaatctgttcgacgtgaagtatgagagtgtggacaaggccaagagttttttcagcaagtttgatagcattcgctataacgttgaacgtgacatgtttgaatggaagtttaattacgatgaattcaccaaaaaagcagaaggtacgaaaacggattggacggtttgttcttacggcaaccgtattattacattccgcaaccctgataaaaactcacaatgggataataaagaaatcaatttaacagagaatattaagttgcttttcgaacgctttggaatcgatttaagttcgaaccttaaagacgaaattatggagcgcacggagaaggaattcttcattgagctgatttcgttgttcaagttggttcttcagatgcgtaactcgtggaccggcactgatattgactacttggtatcaccagtttgtaacgaaaacggtgaattctttgattcacgtaacgtggacgaaaccctgccccagaatgcggacgcaaacggcgcttacaacatcgcccgcaaaggcatgatcttattggacaagattaaaaaaaacaatggtgaaaagaagttaactttaagcattacaaaccgcgaatggctgagttttgctcaaggatgctgtaaaaatggctga

SEQ ID NO: 892 - DNA, 3738 bp, synthetic construct
  misc_feature 1..3738: note = Description of Artificial Sequence: Synthetic polynucleotide
  source 1..3738: mol_type = other DNA
atggaaaccttttctggattcacaaatctgtatccacttagtaaaacgctgcgttttcgtcttattcctgtaggcgagacgcttaagcatttcatcggcagtggtattctggaagaggatcagcatcgtgcggaatcatatgtaaaagttaaagccattattgatgactaccatcgcacctatattgaaaacagtttgagtggctttgagttacccttggaatctacaggtaaatttaattcattagaggaatactatttgtatcataacattcgtaacaagaccgaagagatccaaaatcttagctctaaggtgcgtacaaatttacgcaagcaagtagttactcaattaaccaaaaacgagattttcaagcgcatcgacaagaaggaactgatccagtcagacttaatcgatttcgttaaaaatgagccggacgcaaatgagaaaattgctttgatttcagagtttcgcaacttcactgtgtattttaagggcttccatgaaaatcgccgcaacatgtactccgatgaggagaagagtacttctatcgcatttcgtttaattcatgaaaacttgcctaaatttattgacaatatggaagtgtttgcgaagatccaaaacacttcaatctctgagaactttgacgccatccagaaagagttgtgcccggaattagtcactctttgtgagatgttcaagttgggttatttcaataagactctgtctcaaaagcaaattgatgcctataatactgttattggtggaaagacgactagtgaaggcaagaagatcaaggggctgaacgagtacatcaatttatacaatcaacaacataagcaggaaaaattacccaaaatgaaattactgttcaagcagattttgtctgaccgtgaatcggcatcctggcttcttgaaaagttcgagaatgacagccaggtcgttggcgcaatggtaaacttttggaatacgatccacgatactgtacttgctgagggagggttaaaaacgattatcgcttcacttgggagttatggattggaggggatctttttaaaaaatgatctgcagttgacagacatctcgcaaaaggctaccggttcatggtcgaagatttctagcgagattaagcagaagattgaagctatgaacccccaaaagaagaaggaaagctacgagagttatcaggaacgcatcgataaactgtttaagtcctacaagagcttctccttggcattcgttaatgagtgcttacgtggtgaatataagattgaagactactttctgaagctgggagcagtcaacagctctctgttgcagaaggagaaccacttttcacatattctgaacacttacacggatgtaaaggaggtgattggcttttacagcgagtctaccgacacaaaattaattcaggacaatgattctattcaaaagatcaagcagtttttggatgcagtgaaagacctgcaggcatacgtcaagcctttgttaggcaacagtgatgagactggtaaagacgagcgcttttacggggatttaattgagtattggtccctgcttgacctgattacccctttatataatatggttcgtaattatgttacgcagaagccttactctgttgataagatcaagattaattttcaaaatccgacgcttttgaatgggtgggaccttaacaaggaaatggacaatacgtccgtgatcttgcgtcgtgatggtaaatactacttggccatcatgaataataaaagccgcaaggtctttttaaagtatccatcagggacggaccgtaattgctatgaaaaaatggagtataaattgttacctggtgcgaacaagatgcttccaaaagtatttttctcaaagtcacgtatcaacgagttcatgccaaatgagcgcttgttaagtaactatgagaaaggcacgcataaaaaatccggaacctgcttctccctggatgactgccacacattaattgacttttttaaaaagagtttaaataaacatgaagattggaaaaacttcggcttcaaattctccgacacttcaacgtacgaggacatgagtggattctacaaagaggtagaaaaccagggttataaactgtcctttaaacccatcgatgcgacatatgtcgaccagctggtagacgagggcaagatctttcttttccagatttacaacaaagattttagcgagcactccaagggaacgcccaatatgcacacgttgtattggaaaatgctttttgatgaaacgaacttaggagatgttgtctataaattgaatggagaggcggaggttttttttcgcaaagcgtcaattaacgtatcgcatcctacgcatccagccaacatccccattaaaaaaaaaaaccttaagcacaaagatgaggagcgcattcttaagtatgacctgattaaggataaacgttatacggtggaccagtttcagttccacgtgccgatcaccatgaattttaaagcaaacggcaacggtaatatcaatcagaaagcaatcgactacttacgctcggcctctgacacccacattatcggtatcgatcgcggggagcgtaacttgctttatctggtagtaatcgacggcaacggaaagatctgtgagcagttctcccttaacgagatcgaagtggaatataatggagaaaagtactctactaactatcacgacctgctgaacgtaaaagaaaacgagcgcaaacaagctcgtcagtcctggcagagcatcgctaacatcaaggatctgaaagaaggttacttatcgcaggtgatccacaagattagtgagttaatggtgaaatacaacgcaatcgtcgtacttgaggatttaaacgccggtttcatgcgtggacgccaaaaggtcgaaaaacaagtatatcagaaatttgaaaaaaagcttatcgagaaattgaattacttggtgttcaagaaacaatcaagtgatcttcccggcggtttaatgcacgcataccaattggccaacaagtttgagtcctttaatacgttgggtaaacagtcaggcttcttgttttatattccagcttggaatactagcaaaatggaccctgttacggggttcgttaacttattcgacgtgaagtacgaatcagtcgataaagctaaatcattctttagtaaatttgattcgattcgttacaatgtcgagcgcgatatgtttgaatggaagtttaattatgatgaattcacaaagaaggcggagggcacgaaaacggattggacggtctgctcctatggtaaccgtatcatcacatttcgtaacccggataaaaattcccaatgggataataaggaaattaacctgacggaaaatatcaaattactttttgagcgcttcggaattgacttatcttccaatttaaaagacgaaattatggagcgcaccgaaaaagaattctttatcgagctgatctcgctgttcaaactggtcctgcagatgcgcaatagctggactggaacagacattgattatttagtttcgccggtttgcaacgaaaacggagagttttttgacagtcgtaatgtggacgaaacacttcctcagaacgctgacgcaaatggggcatataatatcgcccgtaagggaatgatcttgttggacaaaattaaaaagaataacggggagaagaagcttacgttatccatcacaaaccgtgagtggttgagctttgcccaaggttgttgcaaaaacgggtga

SEQ ID NO: 893 - DNA, 3738 bp, synthetic construct
  misc_feature 1..3738: note = Description of Artificial Sequence: Synthetic polynucleotide
  source 1..3738: mol_type = other DNA
atggaaaccttctcgggtttcaccaacttatacccccttagtaaaaccttgcgtttccgcttaattccggttggcgagactttgaagcacttcatcggaagcggaatccttgaggaggatcaacatcgtgcagaatcatacgtgaaagtaaaagctatcatcgatgactaccaccgtacttacattgaaaactctttaagcgggttcgaattaccccttgagtccacaggaaagtttaatagcttagaagagtactacctttaccacaatatccgcaacaaaacggaggaaattcaaaatttatcttcgaaagtccgcacaaatcttcgtaaacaggtcgtgacgcagttgacgaagaatgagatttttaaacgcattgacaagaaggaacttattcaaagcgatttaattgattttgttaaaaacgaaccggatgcaaacgaaaagatcgctttgatctccgaatttcgtaatttcacggtatactttaaagggtttcacgagaatcgccgcaacatgtattccgacgaagaaaagagtacatcaattgcattccgcttaatccacgaaaatctgccaaagtttattgacaatatggaagtattcgccaaaatccaaaacacgagcatcagcgagaattttgacgccattcagaaggagttgtgcccggagttagtaacgttgtgtgagatgtttaagcttgggtactttaataaaactctttcgcaaaagcagattgatgcatataacactgttatcggaggaaagacaacgagcgagggtaagaaaatcaaaggattgaacgaatacattaatttatataatcagcaacataagcaggagaagttgcccaagatgaaattactgtttaaacaaatcttatcagatcgtgagagtgcctcgtggctgttagagaaattcgagaatgatagccaggtcgtcggcgccatggttaatttctggaacacaattcatgacacagtattggctgaaggaggattaaaaactatcattgcgtctttaggaagttatgggcttgagggtatttttcttaaaaacgacctgcaactgaccgacatctcacagaaagctactggatcttggtcaaaaatcagctcggagattaagcaaaagattgaggctatgaatccacagaaaaaaaaggaatcgtatgagagctatcaggaacgcatcgataaactgttcaagtcctacaagtcgttctcattagcgtttgtaaacgaatgtttacgtggggagtataagattgaagattacttcctgaaacttggtgcggtcaatagttcgttgttgcagaaagagaatcatttctcgcatatccttaacacttacacggacgtcaaagaagttatcgggttctactcggaaagtacagacactaaattgatccaggacaatgactccatccagaaaattaagcagtttcttgacgctgtgaaagacttgcaggcttatgtaaaaccattgttggggaattcagatgagaccggcaaagatgagcgcttctatggcgacttaatcgaatactggtcgttgcttgatcttattacgccgctttacaacatggttcgcaactacgtcactcaaaaaccctattctgttgataagattaaaatcaatttccagaaccctacgttacttaatggatgggaccttaataaagaaatggacaacacttcggtaattcttcgccgcgacgggaagtattacttagcgattatgaacaacaagtcccgtaaagtattcctgaaatatccctccggtaccgaccgcaattgttacgagaagatggagtataaattattacccggagctaacaagatgctgccgaaggtcttcttctcaaaatcgcgcattaacgaatttatgcctaacgagcgtttgttatcaaactatgagaaaggaactcacaaaaagtccggcacttgcttttcgcttgatgactgccacacgcttatcgactttttcaagaaaagcttaaataagcacgaggactggaagaactttgggtttaagttctcggatacgagcacgtatgaggatatgagtgggttctataaggaagtggagaatcaaggttataaattatcctttaaaccaattgacgctacgtatgtcgatcagctggtagacgagggcaaaatcttcttattccaaatctacaacaaagatttttctgagcatagcaaaggaactccgaatatgcacaccctgtattggaaaatgctgtttgacgaaacgaatttaggcgacgtagtctacaagttgaacggtgaagcagaggtcttttttcgcaaagccagtatcaacgtatcgcaccctacgcacccggcgaatattcctatcaaaaaaaaaaatctgaagcacaaggatgaggagcgtattcttaaatacgacttgatcaaggacaaacgctacacggtggatcaattccagttccatgttccgattaccatgaattttaaggcaaatggcaacggtaatatcaatcaaaaagcgatcgattatcttcgttccgcatcagacactcatattatcggaatcgatcgcggtgaacgtaacttgctgtatctggtggtcattgacggtaatggtaaaatttgcgagcaatttagtctgaacgaaattgaagtcgagtataatggggaaaagtatagtaccaattatcatgatcttcttaacgtcaaggaaaatgagcgtaagcaagcacgtcaatcttggcaatcgattgctaatattaaggatctgaaagagggttacctgtcacaagtcatccacaagatttctgaacttatggtaaagtacaatgcgatcgtcgtcttggaggacctgaacgcgggtttcatgcgcggacgtcaaaaggtcgaaaagcaggtatatcaaaagttcgagaaaaagcttatcgaaaaacttaattatcttgtgttcaagaagcagagtagcgaccttcctgggggcttaatgcatgcataccagcttgccaataagttcgagtccttcaacacacttgggaaacaatctgggtttctgttttatattccggcgtggaatacgtccaaaatggacccagtcaccgggttcgtcaacttattcgacgtaaaatatgaaagcgtggataaggccaagtctttttttagtaaattcgattcaattcgttacaatgtcgagcgcgatatgttcgaatggaagtttaactacgacgagttcacaaaaaaggccgaaggaactaagacggactggacagtatgctcttatggtaatcgtatcatcaccttccgcaatcctgataagaattcccaatgggataataaagaaattaaccttaccgaaaatatcaagctgttgttcgagcgcttcgggatcgacctgagctctaacttgaaggacgaaatcatggagcgtactgagaaggaattttttattgagcttatctcgttatttaaacttgtattgcaaatgcgtaattcatggacaggaacggacattgattacctggtgagcccagtctgcaatgagaatggagagttcttcgactcccgcaacgtcgacgagacgctgccacaaaacgcggacgcgaacggggcatacaatatcgcccgtaaaggtatgatcctgctggacaaaattaaaaagaacaatggtgaaaaaaaattgacgctgagtattactaatcgtgagtggctttcgtttgcgcagggttgctgcaagaacggctga

SEQ ID NO: 894 - DNA, 3786 bp, Moraxella lacunata
  source 1..3786: mol_type = genomic DNA
atgttatttcaagactttactcatttatatcccctatcaaaaaccgtgcgttttgaattaaagcccattggcaagacattagagcatatccatgccaaaaactttttgagccaagataagaccatggcggacatgtaccaaaaggtgaaggcgatactggacgattatcatcgtgattttatcgctgatatgatgggcgaagttaagctaactaagctggcagaattttgtgatgtgtatttaaaatttagaaaaaatcccaaagacgatggattgcaaaaacagctaaaggacttgcaagcagttttaagaaaagagattgtgaagcccatcggtaatggcggaaaatacaaggtgggttatgaccgcttatttggggcaaagctctttaaggacggcaaagagcttggtgatttggcgaaatttgtcatcgcccaagagagcgagtcatcacccaagcttccccaaattgcccattttgagaagtttagcacctactttactggctttcatgacaaccgcaaaaacatgtacagcagtgatgataagcataccgccattgcctatcgtctgattcatgaaaatttgccacgttttatcgataatctacaaatattggcaaccatcaaacaaaagcattcggcattgtatgatcagattgcaagtgaactgactgcaagtggtttggatgtgtcgctagcaagtcatctgggcggctatcacaagcttttaacccaagagggtatcacggcttataataggataataggtgaagtgaatagttatacgaataagcataatcaaatttgccacaaatccgaacgtatcgccaaattacgccccctgcacaaacaaatcctaagcgacggcatgggcgtgtcgtttttgccaagcaaatttgccgatgatagcgagatgtgtcaagcggtcaatgagttttaccgccattatgctgatgtttttgctaaggtgcaaagcttatttgatagatttgatgactatcaaaaggacggcatttatgttgaacataaaaatctaaatgagctatctaagcgagcatttggtgattttgggtttttaaaacgattcttagaggagtattatgcagatgtgattgacccagagtttaatgagaaattcgccaagaccgagcctgatagcgacgaacaaaaaaaactggcaggagaaaaagacaaattcgttaaaggcgtacattccttggcaagtcttgaacaggtgattgagtattataccgctgggtatgatgatgagtctgtacaagcagacaaacttgggcagtatttcaaacaccgtctggcaggcgtggataatccaatccaaaaaatacacaacagtcacagtaccattaaggggtttttggagcgtgaacgtccagcaggcgagcgagcattgcccaaaattaagtcagataaaagtcctgaaatgacacaattaagacaactaaaagagctactagacaacgccttaaacgtggtgcattttgctaagctggtgtcgaccgaaaccgtattagacactcgaagtgataaattttatggcgaatttagacctttatatgttgagcttgccaagattaccacactttataacaaagtgcgtgattatctgtcgcaaaagccatttagcaccgaaaaatataaattaaactttggcaatccgacattattaaacggttgggatttgaataaagaaaaagataattttggggttatcttacaaaaagacggctgttattatttggcgttattggataaagctcataaaaaagtatttgataatgctccaaatacaggtaaaagcgtttatcaaaaaatggtttataagcaaatagcaaatgctcgacgggacttagcttgtttattgattattaatggtaaggtagttagaaaaacaaaaggattggatgatttacgtgagaaatatttaccatacgatatttataaaatttatcaatccgagagctataaggttttatcgccaaattttaatcatcaagacttggttaaatatattgattataacaaaattttagcatcgggatattttgagtattttgattttaggtttaaagaaagctctgaatataagagctataaagaatttttggatgatgtagataactgtggttataaaataagtttttgtaatataaacgccgattatattgatgagttggttgagcagggtcagttgtatttattccagatttataataaagatttctcgcccaaggctcacggtaagcccaatttgcatactttgtattttaaggcattatttagtgaagataatcttgccaatccgatttataagttaaatggcgaggcacagatattttatcgcaaggcgtctttggatatgaatgaaaccaccattcatcgtgcaggcgaggtattagaaaataaaaatcccgataatcccaaacagcgtcaatttgtctatgacatcatcaaagacaaacgttatacccaagataagtttatgctacatgtgcctattaccatgaattttggtgtgcagggcatgacgattgaaggatttaataaaaaagttaatcaaagcatacaacaatatgatgatgtgaatgtgattggcatagaccgtggcgagcgacatctgctatatctgaccgtgattaacagcaaaggtgaaatcttagaacagcgtagtctcaatgacatcatcaccacatcagcaaacggcacacaaatgaccacgccttatcataaaatcctaaataaaaagaaagaagggcgtttgcaggctcgtaaggattggggtgagattgaaaccattaaagagctaaaagcaggctatctaagccatgtggtacatcaaatcagccagcttatgcttaaatataatgccattgtggtgttggaagatttgaattttggatttaagcgtggtcgcctgaaagtggagaatcaggtttatcaaaactttgaaaacgccttaatcaaaaagctaaaccatttggtattaaaagataagacagatgatgagattggctcatataaaaatgccctgcaattgaccaataattttactgacctaaaaagcattggcaaacaaacgggatttttattctatgtgcctgcacggaataccagtaaaatagaccctgaaacgggctttgtggatttgttaaaaccacgttatgaaaatatcactcagtcgcaagcgttttttggtaaatttgataagatttgttataacacagataagggttattttgaatttcatattgattatgccaaattcactgacgaagccaaaaactctcgccaaacatgggtcatttgctcgcatggcgataaacgctatgtgtataacaaaaccgccaaccaaaataaaggggcgaccaagggtattaatgttaatgatgaattaaaatcgctatttgcttgtcatcacatcaatgacaaacagccaaatctggtcatggatatttgccaaaataacgataaagaatttcataaatcgctaatgtatctgttaaaggcattgcttgcattacgatatagtaacgccaatagcgatgaagattttattttatcgcctgtggcaaatgatgagggtgtgttttttaattcggcattggcggatgatacacagccacaaaatgcggacgccaatggggcatatcatatcgcattaaagggtttgtgggtactagaacaaatcaaaaacagcgatgatttggataaagttgatctcgaaattaaagatgacgaatggcgaaactttgctcaaaaccgctaa

SEQ ID NO: 895 - DNA, 3786 bp, synthetic construct
  misc_feature 1..3786: note = Description of Artificial Sequence: Synthetic polynucleotide
  source 1..3786: mol_type = other DNA
atgttatttcaggactttactcatctttatccgctgtcaaaaacggtccgtttcgagctgaaaccgatcggtaagaccttagaacacattcatgcgaagaattttctttctcaagacaaaaccatggcagacatgtaccaaaaagttaaagctattttagatgattatcatcgtgacttcatcgcagacatgatgggcgaagtcaaattaacaaaacttgcggaattctgcgatgtatacttgaaattccgtaaaaatccaaaagatgacggtcttcaaaaacaattgaaagaccttcaagcagtgttacgtaaagagattgttaaacctattggtaacgggggcaagtacaaggtcggttatgaccgcttatttggcgcgaagttgtttaaggatggcaaagaattgggggacctggccaaatttgtgatcgcacaggagagcgagtcttctccgaaattgccgcaaatcgctcactttgagaagttctctacttactttacagggtttcacgacaatcgcaagaatatgtatagtagcgatgataagcacactgctattgcatatcgccttatccatgagaatcttccccgctttattgacaatctgcagatccttgcgacaatcaaacaaaaacattctgctttatacgaccagatcgcctcagagttaactgcgtctgggttagatgtgtcgctggcctcgcacctgggtggctaccacaaactgcttactcaggaaggtattactgcgtataaccgtatcattggcgaggtaaatagctatactaacaaacacaaccagatctgccataaaagtgaacgtattgccaagcttcgccccttacacaagcagatcctttcagacgggatgggcgtcagtttcttaccctctaagttcgcggatgactctgaaatgtgtcaggcagtcaacgaattctaccgtcactacgcagatgtgttcgctaaagtacaaagcttatttgatcgttttgatgattatcaaaaggacgggatttacgttgagcacaagaatttaaacgaattgtcgaagcgcgccttcggggatttcggctttttaaagcgctttctggaggagtactacgcagatgtgatcgatcctgagtttaacgaaaaatttgctaaaacggaacccgatagcgatgaacaaaagaagcttgcgggtgagaaagacaaatttgttaaaggtgttcattcgcttgcgagcttagaacaagtaatcgaatattatacagccggatacgacgatgagtctgtccaagcggataagcttggacaatatttcaaacatcgtcttgcaggcgtagataacccaatccaaaaaatccataattcacattccacgatcaagggtttcttggagcgtgaacgccctgccggggagcgcgcgctgcctaaaatcaaaagtgataaatcgcccgagatgacccaacttcgtcaacttaaggagttattggataacgcgttaaatgtggtccattttgcgaaattggtgagtacggagactgtacttgacacccgttccgacaagttttacggggagttccgcccgttgtatgtggagttggcgaagattactacactttacaataaggtacgcgattacttatctcaaaagccattttcaacggagaagtataagttgaacttcgggaatccaacgttgcttaacggctgggacctgaataaagaaaaagataacttcggggttattttacaaaaggacggttgctactacttggctttattggacaaggcacataagaaagtatttgacaacgcgccaaacacggggaagagtgtgtatcaaaaaatggtctataagcaaattgcaaatgcccgccgtgacttagcctgtttacttatcattaatggcaaggtggtccgcaaaacaaaagggctggacgacttgcgcgaaaaatatttaccctatgatatttataagatttaccaaagcgaaagctacaaagtactttccccgaactttaatcatcaggatcttgtgaagtatattgactataacaagatcttggcgagtgggtattttgagtattttgacttccgttttaaagagtctagtgagtacaaaagttataaggagtttcttgatgacgtagataattgtggctataagatctcattctgtaacatcaatgcggactatattgacgaattggttgaacagggacaactttatttattccaaatttataataaagatttcagcccaaaagcacacggtaagccgaatctgcacacgctgtactttaaagctctgttctctgaggataacctggccaaccccatttataagctgaacggggaggcccaaattttctaccgtaaggcgtccttggatatgaacgagacgaccattcaccgtgcaggtgaggttctggaaaataagaatccagacaacccaaaacagcgccaattcgtgtatgacattattaaagacaaacgctatacacaagataagtttatgttacatgtcccgattacgatgaacttcggtgtgcaaggaatgacaatcgagggttttaacaaaaaagtaaaccaatccatccaacaatacgatgatgtcaatgtaattggaattgatcgtggcgaacgccatctgctttaccttaccgtgatcaatagtaaaggagaaatcctggagcagcgtagtttgaacgatattattactacttctgcgaacgggacgcagatgaccacaccttaccataagattttgaataagaaaaaagaagggcgtttgcaagcgcgtaaggactggggggagatcgagaccattaaagagctgaaagcggggtatttgagtcacgtggtacatcaaattagtcaattgatgcttaaatacaacgctattgtcgtacttgaggaccttaacttcgggttcaaacgcggccgcttaaaggtagagaatcaggtgtatcaaaactttgaaaacgccctgattaagaaactgaatcacctggttcttaaagataagaccgatgatgagattggatcatataaaaacgcattacaactgaccaataattttacggacctgaagtctattggcaaacagactggctttcttttctacgttccggcgcgtaacacgagtaagattgaccccgagactggtttcgttgatttgttgaagcctcgttacgagaacatcacacagtctcaggcttttttcggaaaatttgataaaatttgttacaatacagacaagggctatttcgaatttcacatcgattatgcaaagttcactgatgaggcaaaaaattcgcgccaaacatgggtgatctgctcgcacggagacaaacgttacgtatacaacaagacagcaaaccagaataagggggccactaagggaattaacgtcaacgacgagctgaaatcgcttttcgcttgtcatcacattaacgataagcaaccaaatttggttatggacatctgtcagaacaatgacaaggagtttcataaatcgctgatgtacttgcttaaagctttgttggctttacgttacagcaatgctaactcagatgaagacttcatcttgtcgccggtagctaacgatgagggcgtcttctttaacagcgctctggcagatgacacgcaacctcagaacgcagacgctaacggggcgtatcatattgctctgaaaggactgtgggttttagagcagattaagaattctgacgatttagacaaggtggatttggaaattaaggatgatgaatggcgcaactttgcccaaaaccgttaa

SEQ ID NO: 896 - DNA, 3786 bp, synthetic construct
  misc_feature 1..3786: note = Description of Artificial Sequence: Synthetic polynucleotide
  source 1..3786: mol_type = other DNA
atgttgtttcaggatttcacgcacctgtatccattgtcgaagacggttcgtttcgagcttaaaccaattgggaagactctggagcatatccacgcgaagaatttcttgagccaagataagaccatggcagatatgtaccaaaaagttaaagctatccttgacgactaccatcgcgatttcattgcagacatgatgggagaggtcaagcttaccaagctggcggagttttgcgatgtctacttgaagtttcgtaagaacccgaaggatgacggtcttcaaaagcagttaaaagatttgcaagcggtgttacgtaaagaaattgtcaagccgatcggcaatggtggcaagtataaggttgggtatgatcgtctgtttggtgctaaactttttaaagacggaaaggagttgggagaccttgccaagtttgtaatcgctcaggaatcagagagttcgccaaagcttcctcaaattgcgcatttcgagaagttcagtacctatttcactggttttcatgacaatcgcaagaatatgtactcatcagatgacaagcataccgcaatcgcataccgtttaattcatgaaaatctgccacgcttcatcgataaccttcagatcttagctacaatcaaacaaaaacactccgcactttacgaccagatcgcctccgaattgaccgcaagtggtctggacgtgagcctggcttcccacttggggggataccacaaacttctgacccaagagggtatcacagcgtataatcgcattattggtgaagtaaactcctatactaacaaacacaaccaaatctgtcataaaagcgagcgtattgcgaagttacgccccctgcacaaacaaattctgagcgacggaatgggtgtaagtttcctgccttctaaattcgcagacgatagtgagatgtgccaggcggtcaacgagttctaccgccactacgccgatgtatttgcgaaagttcaaagcctgttcgaccgtttcgatgactaccaaaaggacggcatctacgtggagcataaaaacttgaacgaattatcgaaacgcgcatttggcgatttcggcttcttaaagcgcttcctggaggagtactatgctgatgtaattgacccggagttcaacgagaaatttgcaaagaccgaacctgactctgacgagcagaaaaagttagccggcgagaaggacaaatttgtaaaaggagtgcatagcttggcctcattagaacaagtaatcgagtactatactgctgggtatgatgatgaaagcgttcaggcggataaacttggtcaatactttaaacatcgccttgccggcgtggataacccgattcaaaagattcataactcgcattcaacaatcaagggctttcttgaacgcgaacgcccagctggtgagcgcgccttgccgaagattaagagcgacaaaagcccggagatgactcaattgcgtcagctgaaggagttgctggataatgcccttaatgtggtccatttcgcaaagctggtctcgacggagactgtacttgacacccgttcggacaagttctacggcgagtttcgccctctttacgtggagctggctaaaatcactacattatacaacaaggtgcgcgattacttaagccaaaagccgtttagtacggaaaaatataagttaaacttcggtaacccgaccttgttaaatggatgggacctgaataaagaaaaagacaacttcggcgtgattttgcaaaaagatggttgttactatttagcgttactggataaagcacacaaaaaggttttcgataacgcgcccaacaccggcaaatcagtgtaccagaaaatggtctataagcaaattgcaaatgcccgccgtgacttggcgtgcttattgatcattaatggtaaggtggtacgtaagaccaaggggcttgatgatctgcgtgagaaatatttaccatatgacatctacaaaatttatcaaagcgagagttacaaagttttatcccccaattttaatcatcaggatcttgtcaagtatatcgactataataaaattctggcttcgggatacttcgagtacttcgatttccgctttaaggaatctagcgagtacaaatcgtataaagagttcttagatgatgttgataattgcggatataaaatttcgttttgcaatatcaacgcagattatatcgatgaactggtagagcaagggcagctgtatttgttccaaatttataacaaagactttagtccaaaggcccacggaaagccaaatctgcacactttatattttaaggcgcttttcagtgaagataacttagcgaatcctatttacaagttaaacggcgaggctcagatcttctatcgcaaggcgagccttgatatgaacgagacaacgattcaccgtgcgggcgaagtgttagaaaataaaaacccagataatccaaagcaacgccagtttgtgtatgatatcattaaagacaaacgttacacacaagataagttcatgctgcacgtccccattactatgaactttggtgtgcagggaatgacaattgagggcttcaacaaaaaagtgaaccaatcaattcagcagtacgatgatgtgaatgtcatcgggattgaccgtggggagcgccaccttttgtacctgactgtcatcaactccaagggtgagattttagaacaacgcagcctgaacgatatcattactacctctgccaatggtacccagatgaccacgccttatcacaaaatcttgaacaagaaaaaagagggccgtttgcaggcgcgtaaggactggggagaaattgagaccatcaaagaacttaaggccggatatctttcccatgtggtccatcaaattagccagttgatgctgaaatacaacgccatcgtggtgttggaggatttgaactttggatttaaacgcgggcgtctgaaggtcgagaatcaagtataccaaaactttgagaatgctcttatcaaaaagttgaatcatttagtactgaaggataaaacggacgatgaaattggtagttacaaaaatgccttgcagcttactaacaactttaccgacttaaaaagcatcggtaaacaaactggattcttattctatgtacctgctcgtaacacgtcaaaaatcgacccggaaaccggctttgtcgatttgcttaagccccgttacgagaacatcactcaatcccaggcatttttcggcaaatttgacaagatctgctacaacacggacaaggggtattttgagtttcacattgactatgcaaaatttacggatgaagctaagaacagtcgtcagacttgggtaatctgctcacacggagacaaacgctatgtatataataaaaccgctaatcagaacaagggtgccacaaaaggtatcaacgtgaacgacgagcttaaaagcttattcgcgtgccatcacattaacgacaaacaacccaacttagtcatggatatctgtcagaataatgataaggagttccacaagagcttaatgtacctgttgaaggcgcttctggcgttacgctactcaaatgcaaattcagacgaagacttcattctgtcgcctgtagctaacgatgaaggtgtcttttttaattctgctttggcagatgacacacagccgcaaaatgcggatgcgaacggagcatatcacattgcgttgaagggtctttgggtcttggagcaaatcaagaattctgacgacttggataaggtagatcttgaaatcaaggacgatgaatggcgtaattttgcacagaatcgttaa

SEQ ID NO: 897 - DNA, 3786 bp, synthetic construct
  misc_feature 1..3786: note = Description of Artificial Sequence: Synthetic polynucleotide
  source 1..3786: mol_type = other DNA
atgcttttccaagactttactcacctttacccactttcaaaaacagtacgtttcgaattaaagcctattggcaagacgttagagcacatccatgcaaagaactttttatcgcaagataagacaatggccgatatgtatcagaaagtcaaggcaatcttggatgattatcaccgtgattttatcgctgatatgatgggcgaagttaaattaactaaacttgcagagttttgtgacgtctatttaaaatttcgcaaaaacccgaaagacgatgggttgcagaagcaacttaaagatctgcaggcggtactgcgcaaggaaattgtaaagcccattgggaacggcgggaagtacaaagtggggtatgatcgcctgttcggcgcgaaacttttcaaagacggaaaagaattgggcgatctggctaaatttgttattgctcaagaaagcgagagctcgccgaaattacctcaaattgcgcatttcgaaaaattcagcacgtattttacaggctttcacgataatcgcaagaatatgtattcgtctgacgacaaacacacggcgatcgcgtaccgcttaattcacgaaaatctgcctcgcttcattgacaatcttcaaattcttgcgacaatcaaacagaagcactctgctttatacgaccaaattgctagcgagcttacagcctctggtttggacgtctcacttgctagccatcttggaggttatcacaagttgttgacccaggaagggattacggcctataaccgcattattggagaagtcaactcgtacacgaacaagcacaaccaaatctgtcataaaagtgaacgcattgcaaaattgcgtccgcttcacaaacagattcttagtgatggaatgggggtgtcatttctgccgtcaaagttcgcggatgatagtgaaatgtgtcaggctgtgaatgaattctaccgtcattacgcggacgtattcgccaaggtgcagtcattatttgatcgctttgatgactatcagaaggacggtatttatgtggagcacaaaaatctgaacgaattatccaaacgcgcattcggggacttcgggtttttgaagcgtttccttgaagagtactacgccgatgtcatcgacccagagttcaatgaaaagtttgcgaaaacagaaccagatagtgacgaacaaaagaagctggcaggtgagaaagacaaattcgtcaagggagtgcattctctggcttcattagagcaggttattgaatactacacggcgggctatgacgacgagtcggtgcaggccgataagttagggcagtacttcaagcaccgtttagctggggtcgataatcccatccagaagattcacaattcccacagcacgatcaaaggcttcctggaacgtgagcgccccgcgggcgagcgtgctctgcctaaaattaaaagtgacaagtctccagagatgacccagttacgtcagctgaaagagttattagacaacgcactgaacgtagtacacttcgcaaaactggtatcaacagagacagtcctggatacgcgctcggacaagttttatggtgagttccgccccttgtacgtcgagttggcgaagatcacaacactgtataacaaagttcgtgactatctgtctcaaaagccgttttccacagaaaagtacaagcttaatttcggaaatcctacacttctgaatggctgggacttaaacaaagagaaggacaactttggagtcattcttcaaaaagatgggtgttactacctggcgcttctggacaaggcccataaaaaggtgtttgacaatgccccaaacacaggcaagtctgtctatcagaaaatggtctacaagcaaattgccaacgcccgccgcgacctggcatgtctgcttattatcaacggcaaggttgttcgtaaaacaaaggggctggacgatttgcgcgaaaaatatctgccatacgacatttataagatttatcaatcagaatcttacaaagtcctttccccaaacttcaaccatcaggacttagttaagtatatcgattataataagatcttagcaagtgggtacttcgaatactttgactttcgctttaaagaatccagcgagtacaagagctataaggaatttcttgatgacgttgacaactgtggctataaaatttcgttttgtaacattaatgcggattacattgatgaacttgtagaacaggggcaattgtatcttttccaaatctacaataaagattttagtcccaaggcgcatggaaagccaaacttacataccttatatttcaaagcacttttttccgaggacaacttggctaacccaatttataagcttaacggggaagcgcagatcttttaccgcaaagcaagtttagatatgaacgaaaccacgattcaccgtgccggagaggtcctggaaaacaaaaatccagacaatccgaaacagcgccaattcgtgtatgatatcatcaaagacaagcgttacacgcaggacaaatttatgttacatgttccaatcaccatgaactttggcgtacaaggcatgaccatcgagggatttaataagaaggtcaatcaatcaattcagcaatatgacgatgtcaatgtaatcgggatcgatcgtggagagcgccacctgctgtacctgactgtcatcaactcaaagggtgagatcttagagcagcgttcgttgaatgacatcattaccacatcagctaatggtacccaaatgaccacaccataccacaaaatcctgaataaaaagaaagaaggccgcttgcaggcgcgtaaagattggggcgagattgaaacgattaaggaactgaaagcaggttacttgtctcatgttgtacatcaaatttcacaactgatgttgaaatataatgcgattgttgtattggaggatttgaatttcggatttaagcgcggacgccttaaagttgagaatcaagtgtaccaaaacttcgagaacgccttgatcaaaaagcttaaccatttggtgcttaaggataagacagacgatgagattggcagttataaaaatgcattgcagcttacgaacaactttaccgacctgaaatctattgggaaacaaacgggttttttattttatgtgccggcgcgcaacacgtccaaaattgatccggagacaggatttgtcgatcttcttaaaccccgttacgaaaatatcacccagtcgcaagcctttttcggcaaattcgataagatttgttataacacagacaagggatactttgaattccacattgactacgcaaagtttaccgatgaagccaaaaactcacgtcaaacatgggtcatttgcagtcacggtgataagcgttacgtttataataagaccgccaatcagaataaaggtgcaacgaaaggtatcaacgtaaatgatgaacttaagagccttttcgcctgccaccatattaacgacaagcaaccgaatttagttatggacatctgtcaaaacaatgataaagaatttcataaatctctgatgtatttgcttaaggcgctgttagcccttcgttattctaatgcaaacagcgacgaggatttcattctgtccccagtggcaaacgatgagggggtgtttttcaattcggccttggccgatgacacccagccccaaaacgcggatgcaaacggggcgtaccacattgcgctgaagggcctttgggtattagagcaaatcaagaactccgatgacttagataaagtggacctggaaatcaaggacgatgagtggcgtaattttgcacagaatcgctaa

SEQ ID NO: 898 - DNA, 3828 bp, unidentified
  misc_feature 1..3828: note = Description of Unknown: Lachnospiraceae bacterium sequence
  source 1..3828: mol_type = genomic DNA
atgggtaaaaatcaaaattttcaggaatttattggggtatcaccacttcaaaagactttaagaaacgaattgatcccaacagaaacaacaaaaaagaatattactcagcttgatcttttgacggaggatgaaatccgtgcgcaaaatcgagagaagctgaaagagatgatggatgactactaccgggatgtgattgatagcactttgcatgcgggtatagctgttgattggagctatttattttcgtgtatgcgaaatcatctaagggagaattccaaagagtcaaagcgggaattggaacgaacacaggattctattcgttcacaaatctataataagtttgctgaacgagcggattttaaggatatgtttggagcatcgataataacaaaattacttccgacatatataaaacagaatccagaatattccgagcggtatgacgagagcatggaaattttgaaactgtatggaaaattcacaacatcgttgaccgattactttgagacaagaaagaatatcttttctaaagagaaaatatcttctgccgttggatatcgaatcgtagaggaaaatgctgagatcttcttgcagaatcagaatgcttacgacagaatctgtaagatagcgggactggatttacatggattggataatgaaataacagcatatgttgatggaaaaacattaaaagaagtatgttcggatgaaggatttgcaaaggctattacacaagaagggattgatcgctacaacgaggcaatcggtgcagtaaatcaatatatgaatctgttatgccagaagaataaggcattaaaaccgggacaatttaagatgaagcggttacataaacagattctttgcaaaggaacaacctctttcgatattccaaagaaatttgaaaatgataaacaggtgtatgacgcagttaattcttttacagagatagtaatgaagaataatgatttgaagcgactgttaaatattacacagaatgtaaatgattatgacatgaataaaatctatgtagcagccgatgcatatagtacgatttcacagtttatcagtaaaaaatggaatctgattgaagaatgtttgctggattattatagcgataatttgccgggaaaaggaaatgcgaaagaaaacaaagttaaaaaggcggtaaaggaagaaacgtatcgcagtgtttcacagttgaatgaacttattgagaaatattatgtggaaaagacaggacagtcagtatggaaagtggaaagttatatttcgaggctggcagaaacgattacattggaattgtgtcatgagatagaaaacgatgagaagcataatctgattgaagatgatgacaagatatccaagatcaaggaactgttggatatgtacatggatgcatttcatattataaaagtgttccgggtgaatgaagtattgaatttcgatgaaaccttttattcggagatggatgagatttatcaggatatgcaggaaatcgttccattatacaatcatgttcgaaactatgttacacagaaaccatataaacaggagaaatatcgtttatatttcaacactccaacattggcaaatggctggtccaagaataaggaatatgataacaacgctattatcttaatgcgagatgataaatattatttaggtattctgaatgcaaaaaagaaaccatcgaaacaaactatggcgggcaaagaggactgtttagaacatgcgtatgcaaagatgaattattatttgttgccgggtgcgaacaagatgcttccaaaagtatttttatctaagaaaggaatacaggactatcacccatcatcatatattgttgaaggatataatgaaaagaaacatattaaaggttccaagaattttgatatccggttttgtagggatttgattgactacttcaaggaatgcattaaaaaacatccggattggaataagtttaactttgaattttctgcgacagaaacatatgaggatatcagtgtcttttatcgcgaagttgaaaagcaaggatatcgcgtagagtggacgtatatcaatagtgaagatattcagaaactggaagaagatggacagttgtttttatttcagatatataacaaagattttgctgtgggaagtacaggtaaaccaaatcttcatacattgtatctgaaaaatctgttcagcgaagaaaatttgcgggacattgtattaaaactaaatggggaagcagaaatattcttccgtaaatcaagtgttcaaaaaccggtgattcataagtgcggcagtattttagtcaatcgtacctatgagattaccgagagtggaacaacacgggtacaatcaattccggaaagtgaatacatggaattatatcgctactttaatagtgaaaagcagatagaattatcagatgaggcaaaaaaatatttggacaaggtgcaatgtaataaggcaaagacagatattgtgaaagactaccgatacaccatggacaagttttttattcatcttccgattacgattaattttaaggttgataagggtaacaatgttaatgccattgcacagcaatatattgcagagcaggaagatttgcatgtgataggaatcgatagaggagaacggaatctgatttacgtttctgtaattgacatgtatggcagaattttagagcagaaatcctttaaccttgtggaacaggtatcgtcgcagggaacgaagcgatattacgattacaaagaaaaattacagaaccgggaagaggaacgggataaagcaagaaagagttggaagacaatcggcaagattaaggaattaaaagaggggtatctgtcgtcagtaattcatgagattgcacagatggtcgtaaagtataacgcaatcattgcaatggaagatttgaattatggatttaagcggggaagattcaaagtagagcgccaggtatatcagaaatttgaaacgatgttgatcagtaagttgaattatctggcagataaatctcaggctgtggatgaaccgggaggtatattacggggatatcagatgacttatgtgccggataatattaagaatgttggaagacaatgtggaataatcttttatgtgccggcagcatatacctccaagattgatccgacaaccggatttatcaatgcatttaagcgggatgtggtatcaacaaatgatgcaaaagagaatttcttgatgaagtttgattctattcagtacgatatagaaaaaggcttatttaagttttcatttgattacaaaaattttgccacacataaacttacacttgcgaagacaaaatgggacgtatatacaaatggaactcgaatacaaaacatgaaagttgaaggacattggctttcaatggaagttgaacttacaacgaaaatgaaagagttgctggatgactcgcatattccatatgaagaaggacagaatatattggatgatttgcgggagatgaaagatataacaaccattgtgaatggtatattggaaatcttctggttgacagtccagcttcggaatagcaggatagataatccggattacgatagaattatctcaccggtactgaataatgatggagaattttttgattctgatgaatataattcatatattgatgcgcaaaaggcaccgttaccgatagatgccgatgcaaatggcgcattttgcattgcattaaaaggaatgtatactgccaatcagatcaaagaaaactgggttgaaggggagaaacttccggcggattgcttgaagatcgaacatgcgagttggttagcatttatgcaaggagaaaggggatag

SEQ ID NO: 899 - DNA, 3828 bp, synthetic construct
  misc_feature 1..3828: note = Description of Artificial Sequence: Synthetic polynucleotide
  source 1..3828: mol_type = other DNA
atgggtaagaatcaaaactttcaagaattcattggcgtttctcctttacaaaaaactttacgtaatgaactgattcccacggaaaccacgaagaaaaacatcacccagcttgacttattaacagaggacgaaattcgtgctcaaaatcgtgaaaagcttaaggagatgatggacgattactatcgcgacgtaatcgactctacgttacatgcaggcatcgccgtcgattggtcgtacttatttagttgtatgcgtaatcatttgcgcgagaatagcaaggaatcgaagcgcgagctggaacgcacgcaggacagcattcgctcacaaatctacaacaaattcgcagaacgcgctgactttaaggatatgttcggtgccagtattattaccaaattactgcctacgtacattaaacaaaatccagagtacagtgaacgttacgatgagtctatggaaatccttaagctgtatggtaaattcactacatcacttactgattatttcgaaacacgcaaaaacattttcagtaaagagaagatctcaagtgccgtggggtaccgcattgttgaagagaatgcggaaatcttcttacaaaaccaaaatgcgtacgatcgcatctgtaaaattgccggattggacctgcatggcttagataatgagatcacagcctatgtggacggtaaaacgctgaaagaggtttgctcggatgagggtttcgcgaaggcgatcacccaagaaggcatcgaccgttataacgaggccatcggggcagtcaatcaatatatgaatctgctgtgtcagaagaataaggcgcttaagcccgggcaattcaaaatgaagcgtttgcataagcaaatcctttgcaaaggtactacgagtttcgacattccgaagaagttcgagaacgacaagcaagtgtacgacgcagttaattcgtttacagaaatcgttatgaaaaacaacgatttaaagcgccttttaaatattactcaaaacgtcaatgattatgacatgaataagatttacgttgctgcagatgcgtactctacaatctctcagttcatctccaagaaatggaatttgatcgaggaatgtttgttggactactacagcgataacttgcccggcaagggaaacgcgaaggagaacaaagtaaagaaggcggtgaaagaagaaacttatcgtagtgtgtcacagcttaatgagttgatcgagaagtattacgtagaaaaaaccggtcaaagcgtatggaaggtggagagttacatttctcgtttggccgaaacaattaccctggagctgtgtcatgaaattgaaaacgatgaaaaacacaatctgattgaagatgatgacaaaattagcaaaatcaaagagctgctggatatgtacatggatgcgttccatattatcaaggtttttcgcgtcaacgaagtactgaattttgatgaaactttttactccgaaatggacgaaatttatcaggacatgcaagagattgtccctctttataaccatgttcgtaactacgtgacgcagaagccatacaaacaagagaaatatcgcctgtattttaatacgcctacgttagcaaatgggtggtcaaaaaacaaggaatatgataacaatgctatcattcttatgcgtgatgataaatactatctgggtattttgaatgccaaaaagaaaccatccaagcaaacaatggccggtaaagaggactgcctggagcatgcatatgcgaagatgaactattatcttttaccgggcgctaataaaatgctgccgaaggtattcctgagtaagaaaggtattcaagactatcatcccagttcctacattgttgaaggttataacgagaagaaacacattaaaggttcgaagaattttgacatccgcttctgtcgcgacttaattgactacttcaaagaatgcatcaagaagcaccccgactggaataaatttaattttgagttcagtgccactgaaacgtatgaagacatttccgtgttctaccgcgaggtggaaaagcaagggtatcgcgtcgaatggacgtatattaactcggaagatattcagaagctggaagaagacggacagttattcctttttcagatctataataaagatttcgccgtaggttcgacaggtaagcccaaccttcacaccttgtacttaaagaatttgttttctgaagagaacctgcgtgacatcgtcttgaagctgaatggcgaggctgaaatcttttttcgtaagtcctcagttcaaaagccggttatccataagtgcggcagtattttagttaaccgcacgtatgaaattacggagagtggcaccacccgcgtccagtcaattccggaaagtgagtatatggaattgtaccgctattttaattcagaaaaacaaatcgagctttcagacgaagcgaagaaataccttgataaggtccagtgtaataaagccaagacggatattgtaaaggattatcgttacactatggataagtttttcattcatcttccaatcacgattaatttcaaagttgataagggcaacaacgtgaatgcaattgcccaacagtacattgccgaacaggaggaccttcacgttatcgggattgaccgtggagaacgcaacttaatttacgtctctgtcattgacatgtatggccgtattttggaacagaaatcatttaacttagtcgagcaagtgtcttcgcagggcaccaaacgctattatgattacaaagagaagttgcaaaaccgcgaggaagaacgcgataaggctcgtaaatcatggaagacaatcgggaagatcaaggaattgaaagaaggctacctgtcgagtgtgattcacgagattgcccagatggtggtcaaatacaacgcgattattgcaatggaggaccttaactatggattcaaacgcgggcgttttaaggtggaacgccaagtttatcaaaagtttgaaacaatgcttatctctaaattaaactatttagcagataagagtcaagccgtggacgagcccggtggcatcttgcgcggataccagatgacttacgtgccggataacatcaaaaacgtgggccgccaatgtggcattatcttttacgtgccggccgcctacacttccaagatcgatcctaccacggggtttattaatgcatttaagcgcgacgtggtatcaacaaatgacgcaaaggaaaactttctgatgaagtttgacagcatccagtacgacatcgagaagggattatttaaattctctttcgactataaaaattttgctacccacaaactgacccttgcgaagacgaagtgggatgtatatactaacgggacccgcattcagaacatgaaggttgaaggacactggctttcgatggaggtcgagcttaccactaagatgaaggagttattggacgacagtcatattccttatgaggagggtcagaacattttagacgatctgcgcgagatgaaagacatcacgacgatcgtgaacggaattttggaaatcttctggttgactgtgcaacttcgtaactcgcgcattgacaatcccgactacgaccgcattatctcgcccgtgctgaataacgatggggaatttttcgactcagacgaatataattcctatatcgacgcgcagaaagcgccactgcctatcgacgccgatgcgaatggagcgttttgcattgccttgaaggggatgtacacggcaaatcagatcaaagagaactgggttgaaggagagaaattaccggctgattgcctgaagatcgagcatgcctcttggttggcgtttatgcagggtgagcgtggctag

SEQ ID NO: 900 - DNA, 3828 bp, synthetic construct
  misc_feature 1..3828: note = Description of Artificial Sequence: Synthetic polynucleotide
  source 1..3828: mol_type = other DNA
atgggtaaaaaccaaaattttcaggagttcatcggtgtaagcccccttcagaaaactcttcgcaatgaactgattcccactgaaactacgaagaagaatattacacagttggatctgttgaccgaggacgaaattcgcgcacagaatcgtgaaaaacttaaggaaatgatggacgactactatcgcgacgtgattgatagtacactgcacgcgggcattgctgtcgactggagctaccttttttcgtgcatgcgcaaccacctgcgcgaaaattctaaggaaagtaaacgtgagcttgagcgtacacaggactctattcgttcccaaatttacaacaaatttgcagagcgtgcggatttcaaagacatgttcggcgcctcaatcattactaaattactgcccacctatattaagcaaaatcctgagtattctgagcgctacgatgagtctatggaaatccttaaactgtatggaaagtttacaacatcattaacggattattttgaaacgcgtaagaacatttttagtaaagaaaagatctccagcgccgtcggctaccgtattgtcgaggaaaacgctgagatctttttgcaaaaccaaaacgcatatgatcgtatttgcaaaattgctgggcttgaccttcatgggttggacaacgagatcacagcatatgtggatgggaaaacgctgaaggaagtctgtagtgatgagggcttcgcaaaagcgatcactcaggaaggtattgatcgctacaatgaggcaattggcgcggttaaccaatacatgaatttactttgtcagaaaaacaaagcgttgaagcctggtcagtttaagatgaagcgtcttcataaacagattttatgcaagggtaccacgtcctttgatatcccgaaaaagttcgaaaacgacaaacaagtgtatgacgccgtcaatagctttacggagatcgtaatgaaaaataacgatctgaagcgtcttttgaatattacacagaatgtgaatgactatgatatgaacaaaatttacgtagccgcagatgcgtattctacgatcagtcagttcattagcaaaaagtggaacttaatcgaagaatgccttcttgactactatagtgataaccttccaggcaaaggaaacgctaaggaaaataaggtgaagaaggccgtgaaggaagaaacgtatcgtagtgtctcacagttgaacgaattgatcgagaagtattatgtggaaaagactggacagtcggtgtggaaggttgagtcatacatctcgcgcttagcagagaccattactcttgagttgtgtcatgagattgagaacgatgaaaaacacaatttaatcgaggatgacgacaaaatttcgaaaatcaaggaattattggatatgtatatggacgcatttcacatcatcaaggttttccgtgttaacgaagtattaaatttcgacgagactttttattccgaaatggatgagatttaccaggatatgcaagaaatcgtgcctttgtataaccacgttcgcaactacgtaacccaaaagccatacaaacaagagaagtatcgtttgtatttcaacacgccaactcttgcaaacggttggtcgaaaaataaggagtacgataacaatgccatcattctgatgcgcgatgacaagtactacttaggtatcttaaatgcgaaaaagaagccttcgaaacaaactatggccgggaaggaagattgcttagagcatgcttatgctaagatgaactactacttgttgccaggggctaataagatgctgcctaaagtctttctgtcgaagaaggggattcaggactaccatccgtcatcgtatattgtggagggctacaacgagaagaaacacatcaaaggttctaagaattttgatattcgcttctgccgcgatttgattgactacttcaaggaatgcatcaaaaagcatccagattggaacaaatttaacttcgaattttccgccactgaaacctatgaagatatctccgtattttaccgcgaggtcgaaaagcagggttaccgcgtagagtggacatatattaattcagaagacattcagaaattagaagaggatggtcagttgtttctgtttcagatctataacaaggatttcgcggtcgggtccactgggaagcctaatttgcatacgctttatttaaaaaacttatttagtgaagaaaacctgcgtgacattgtactgaaacttaatggtgaagcagaaatttttttccgcaagtcgtccgtccagaaacctgttatccataagtgcggtagtatcctggtcaatcgcacttatgaaattacggagagtggcacgactcgcgtgcagtcaattccagagtcggaatacatggagctgtaccgttatttcaactctgagaaacaaatcgagctgtctgacgaggcaaagaagtatcttgacaaggttcaatgtaacaaggctaagacggacatcgtgaaagattaccgctataccatggacaaattttttattcatctgcccatcactatcaactttaaggttgacaaaggtaacaatgtgaatgcaattgcgcaacaatacatcgccgagcaagaggacttacacgtcattggaattgatcgtggggaacgtaacttgatctacgtgagcgtcatcgatatgtacggtcgtattttagaacaaaaatcatttaatttggtcgaacaagtttcatctcaaggaacgaagcgctactacgattataaggaaaaacttcaaaaccgtgaggaagagcgcgataaggcacgcaagtcgtggaagacaattggcaagatcaaggaattgaaggagggctatctgagcagcgtgattcatgaaattgcccaaatggttgtcaaatacaacgcgatcattgcgatggaagatctgaactatggatttaagcgtgggcgctttaaagtagaacgtcaggtgtatcagaagtttgagacaatgctgattagcaaattaaattatctggccgacaagagccaagcagttgacgaacctggcggtattttacgcggttatcaaatgacctacgtgcccgacaacatcaaaaacgtgggacgccaatgtgggattatcttctacgtcccagcggcctatacatctaaaatcgacccgacaactggatttattaacgcgtttaaacgtgatgttgtttctacaaatgatgccaaagaaaacttccttatgaaattcgactccatccaatacgatattgagaaaggccttttcaagttcagcttcgactacaagaacttcgcaacgcataagcttacccttgctaaaactaagtgggatgtatatacgaacgggacccgtattcagaatatgaaagtcgaggggcattggctgtcaatggaagtagaacttaccacaaagatgaaagaattactggacgactctcatatcccgtacgaagaaggtcagaatatcctggatgatcttcgcgagatgaaagacatcacaactattgtgaacggcattttagaaattttttggctgaccgtacaacttcgcaacagtcgtatcgacaaccccgactacgaccgtattatcagtcccgtccttaacaacgatggagaattttttgattcagacgagtataactcctacatcgatgcccagaaagcgcccttaccgatcgacgccgacgcaaacggagcattttgcatcgcacttaaggggatgtacactgccaaccagattaaggaaaattgggtagaaggtgaaaagttacccgctgattgtcttaaaattgagcatgcgtcctggttagctttcatgcagggcgagcgtggatag

SEQ ID NO: 901 - DNA, 3828 bp, synthetic construct
  misc_feature 1..3828: note = Description of Artificial Sequence: Synthetic polynucleotide
  source 1..3828: mol_type = other DNA
atgggtaaaaaccagaattttcaggaatttatcggtgtttccccacttcaaaagacattgcgcaacgaacttatccctactgagacgactaaaaagaacatcactcaattggaccttctgacagaagacgaaattcgtgcgcaaaatcgtgagaaacttaaggagatgatggacgattactatcgtgacgttatcgattccacactgcacgcgggtatcgctgtcgactggtcttacctgtttagctgcatgcgcaaccacttgcgtgagaatagcaaagagagcaaacgcgaattggagcgtacgcaggactcaattcgttcccagatttataataagtttgcagagcgtgctgatttcaaggatatgtttggtgcgagcatcatcactaaattgctgcccacgtatatcaaacagaatcctgagtattcggagcgctatgatgaaagcatggagatccttaaattatatgggaaatttacgacaagcttgaccgactattttgagacgcgcaaaaatatcttttccaaagagaagatttccagcgccgtaggttaccgtattgtcgaggagaatgcggaaatttttttgcaaaaccaaaatgcgtatgaccgtatctgtaaaatcgccggtctggatcttcatggcttggataacgaaatcacggcatacgtcgatggtaagacccttaaagaagtctgttctgacgagggtttcgccaaggcaattacccaagagggaattgaccgctacaacgaagctatcggcgccgttaaccaatatatgaatcttctgtgtcaaaaaaacaaggccttaaaacccggacagttcaaaatgaagcgtttacacaagcaaattctgtgtaagggaacgacgtcttttgatattccaaaaaagttcgaaaacgacaaacaagtttacgatgccgtcaactcctttactgagattgttatgaaaaacaatgatttgaagcgcctgttgaacatcacgcaaaatgtcaatgactacgacatgaacaagatttacgtggccgccgatgcgtatagtacaatcagtcagttcattagcaagaaatggaatttgatcgaagaatgtttgttagactactatagtgacaatttacccggaaagggcaacgcaaaggaaaacaaggttaaaaaagctgttaaggaggaaacctatcgtagtgtcagccaattgaacgagttaatcgaaaaatactatgtagaaaaaacgggacagtccgtttggaaagtcgaaagttacatttcccgcctggcagaaactattaccttggagctttgtcatgaaatcgaaaacgacgaaaagcacaatttgatcgaggacgacgataaaatttcaaagattaaagaattgttagacatgtatatggatgccttccacatcatcaaagttttccgtgtcaacgaggttttaaattttgacgagacattctactcagaaatggatgagatctatcaggatatgcaagaaatcgtgccactttacaatcatgtgcgcaattacgtcactcagaaaccgtataagcaggagaagtatcgcctttacttcaacactccgacactggcgaatgggtggtcgaagaacaaggaatacgacaataacgccattatcttaatgcgcgacgataaatattatctgggcatcctgaacgcaaagaaaaaaccatctaagcaaacgatggcggggaaagaagactgcttggagcacgcctacgcaaaaatgaattactacttgttgccaggcgcgaacaaaatgcttcccaaagtatttttgtccaaaaagggcattcaggactatcacccttcatcatacattgtggagggttataatgagaaaaaacacatcaaaggatctaagaactttgatatccgcttctgccgtgacttgatcgactattttaaggaatgtatcaagaagcatcctgactggaacaagttcaattttgagtttagtgccacagaaacttacgaggatatctcagtcttctaccgtgaagtcgagaaacagggctatcgcgtagagtggacatatatcaacagcgaagatatccagaaactggaagaagatggtcagttattcttgttccagatctataataaggattttgcggtaggaagtactggcaaaccaaatcttcacacactgtatctgaaaaatcttttttcggaagagaatctgcgcgatattgtgctgaaacttaatggggaggcggaaatctttttccgcaagtcatccgttcaaaagcctgttattcataaatgtggttccattctggtaaatcgcacgtatgaaatcaccgagtcgggcacgacccgcgtccagtcgattcctgagtccgagtatatggagttgtaccgttattttaacagcgagaaacagatcgaattatccgacgaggcaaaaaaataccttgataaagtacaatgtaacaaggcgaaaacggatattgttaaagattatcgctacaccatggacaaattcttcattcacttacctattaccattaactttaaggtcgacaagggcaacaatgttaacgctatcgcacaacaatacattgcagagcaagaagacctgcatgttattgggatcgaccgcggggagcgcaatttaatttacgtctcggtgattgatatgtatggccgtattttagagcaaaaaagtttcaacctggttgagcaagtgtcttcgcaaggtaccaaacgttactacgattataaggagaaattacagaatcgcgaggaggagcgcgataaggctcgcaaatcgtggaagacaatcggtaagatcaaggagcttaaagagggctatttaagctcagtgattcatgaaattgcgcagatggtcgtcaagtataatgccattattgcaatggaggaccttaactatgggttcaagcgcggacgtttcaaagtcgaacgccaagtatatcagaagttcgaaactatgcttatctctaagttaaactacttagctgataaatctcaagctgttgatgaaccggggggtatcctgcgtgggtaccaaatgacatacgtcccggataacatcaaaaatgtaggccgtcagtgtggtatcattttctacgtgccggctgcatatacgagtaaaatcgaccccacaacaggatttatcaatgcctttaaacgtgacgtcgtttcaaccaacgatgcaaaggagaatttcctgatgaaatttgattcgatccaatacgacatcgagaaaggtctgtttaagttttcgttcgactataaaaactttgcgacgcacaaacttacgttagccaaaacaaagtgggacgtatatactaacggaacacgtatccagaatatgaaagtcgaaggtcactggcttagtatggaggtagagcttactaccaagatgaaggagttattagatgactctcatattccttatgaagaagggcaaaatatccttgatgatcttcgcgagatgaaagatattacaaccatcgtaaatggtatccttgagattttttggttgacggtgcagcttcgcaactcgcgtattgataaccccgactacgatcgcattattagcccggtacttaacaatgacggggagttctttgatagcgatgagtataattcctatatcgacgcacagaaagcaccattacccatcgacgccgacgccaacggggctttctgtatcgctttaaaaggtatgtacaccgccaatcaaatcaaggaaaactgggtcgaaggggagaaattgccggcagattgcttaaaaatcgagcacgcgagttggctggcctttatgcagggagaacgcggctag

SEQ ID NO: 902 - DNA, 3786 bp, Moraxella sp.
  source 1..3786: mol_type = genomic DNA
atgaatacaagtttattttcatcattcactcgccaatatccagttaccaaaaccttgcgttttgaattaaaaccaatgggtgcgacattggggcacattcagcaaaaaggttttttacacaaagatgaagagctggcaaaaatttacaaaaaaatcaaagaactgcttgatgagtatcatcgggcgtttattgcagatacgctgggcgatgctcagcttgtgggcttggatgatttttatgcagattatcaagcactcaaacaagacagtaaaaacagtcatctaaaagataagctcaccaaaacccaagacaatttacgcaaacaaatcaccaaaaattttgaaaaaacaccacagcttaaagaacgctataagcgtttgtttactaaggagctgtttaaagctggtaaggataaaggagatttggaaaaatggctgataaatcatgacagtgagccaaataaggcagaaaaaatctcatggattcatcaatttgaaaattttaccacctattttcaaggattttatgaaaatcgcaaaaatatgtacagtgatgaagtcaaacatactgccattgcttatcgtttaatccatgaaaatttgccacgctttgttgataatatacaagttttatccaaaatcaaatcggattatcctgatttatatcacgaattgaatcatttggacagtcgcacgattgattttgctgattttaagtttgatgatatgttacagatggatttttatcatcatctgcttatccaatcaggcatcaccgcttataatacgcttttgggcggtaaagtattagaaggtggtaaaaagttgcaaggcatcaatgagttaataaatctatatggtcaaaaacataaaattaagattgcaaaattaaagcctttgcacaaacaaatattaagtgatggacaaagcgtctcatttttgcccaaaaagtttgataatgattatgaattgtgccaaactgtcaatcatttttatcgtgaatatgtggctatttttgatgagctggtggttttatttcaaaaattttatgattatgacaaagacaacatatatatcaaccatcaacagctcaatcaactatcgcatgagttatttgctgattttaggttattatcacgtgcgttggacttttattattgtcagataattgatggtgattttaataataaaatcaacaacgccaaaagccaaaatgccaaagaaaaattattaaaagaaaaagagcgatacaccaaatcaaatcatagcatcaatgaattgcaaaaggcaatcaaccactatgccagtcatcatgaagacacagaagttaaagtcattagtgattatttttcagcgacaaacattcgtaatatgattgatggcattcatcatcattttagtacaatcaaaggttttttggaaaaggataataaccaaggcgagagttatctgcccaaacaaaaaaacagcaatgacgttaaaaatttaaaattatttttagatggtgttttgcgactgattcattttatcaaacctttggcattaaaatcagatgataccctagaaaaagaagagcatttttatggggagtttatgcctttgtatgataaattggtaatgtttacgctgctgtataataaagtgcgtgattatattagtcaaaaaccctataatgatgaaaaaatcaaactcaactttggcaattcaactttattaaatggttgggatgtcaataaagaaaaagataattttggggtgatattatgcaaagagggtttgtattatttggcgattttagataaatcccacaaaaaagtctttgataatgcaccaaaagcaaccagtagccacacatatcaaaagatggtatataagctactgccaggacctaataaaatgctgcccaaagtgttttttgcaaaaagtaatattggttattatcagccatcggcacaattattagaaaactatgaaaaaggcacacacaaaaaaggcagtaattttagtttaacagactgtcatcatttgattgatttttttaaatccagcattgccaagcatccagagtggaaagagtttggttttagattttctgacactcacacttatcaggatttaagtgatttttataaagagatagagccgcaatcttataaagttaagtttattgatattgatgctgattatattgatgatttggttgaaaaaggtcaattatatctgtttcaattatacaataaagatttttcaaagcaatcttatggtaaaccaaatctgcacaccttatattttaagtcattgtttagtgatgataatctcaaaaatccgatttataaactcaatggcgaagctgagatattttatcgccgtgcttcattgagtgtgtctgatacgaccattcatcaagcaggagaaatattaacacccaaaaatcccaataatacccataatcgcacattaagttatgatgtgattaaaaataaacgctatacaacagataagttttttctgcacataccgattaccatgaactttggtatagaaaatacaggatttaaagcatttaatcatcaagtcaataccactttaaaaaacgctgataaaaaagatgtgcatatcatcggtattgaccgtggagaaagacatttgttgtatgtcagcgtgattgatggcgatggtcgtattgtggagcagcgaacgttaaatgatattgtatccatttctaataatggcatgagcatgagtacgccgtatcatcagatattggataacagagaaaaagagcgtttggcggctcgcaccgattggggggatattaaaaatatcaaagaattaaaggcagggtatttaagtcatgtggtgcatgaagtggtgcagatgatgttaaaatataatgccatgattgttttggaagatttaaattttggttttaaacatggtcgctttaaggtggaaaagcaagtttatcaaaattttgaaaatgcattgattaaaaaattaaattatttggtattaaaaaacgctgataatcaccagctaggttctgtgcgtaaggctttgcaattaaccaataattttaccgacataaaaagtattggcaaacaaacagggtttattttttatgtgccagcatggaataccagtaaaatagacccaaccacaggttttgtggatttgttaaaaccccgttatgaaaatatggcacaggctcaaagttttatcagcaggtttaaaaagattgcttataatcatcagcttgattattttgaatttgagtttgattatgccgatttttatcaaaaaacgatagataaaaaacgtatttggactttatgcacttatggtgatgtgcgttattattatgaccataaaactaaagaaacaaagaccgttaatattaccaaagagttaaaatcattgttggataagcatgatttaagttatcaaaatggtcataatttggtagatgagctggcaaattctcacgacaagtcattattaagtggcgtgatgtatttattaaaagttttgttggcattaagatatagtcatgctcaaaaaaatgaagattttattttatcccctgtgatgaataaagatggtgtgttttttgacagtagatttgctgatgatgtgttgccaaataatgctgatgcaaatggtgcttatcatattgctttaaagggattatgggtgctcaatcaaatccaatctgccgataatatggataagattgatttgagcatctctaatgagcagtggctacactttacacaaagccgctaa

SEQ ID NO: 903 - DNA, 3786 bp, synthetic construct
  misc_feature 1..3786: note = Description of Artificial Sequence: Synthetic polynucleotide
  source 1..3786: mol_type = other DNA
atgaacacgtcacttttcagcagttttactcgtcagtatcctgttactaaaacgttgcgctttgagctgaaacccatgggagccactcttggccacattcaacagaaaggatttctgcacaaggacgaagagctggctaagatttacaagaaaattaaggaattgctggatgaatatcaccgtgcattcattgccgacaccttaggggatgcgcagttagtaggattggacgacttttatgccgattaccaggcacttaaacaagattcgaagaattctcaccttaaagacaagctgacgaagactcaggataacctgcgtaaacaaatcacgaaaaattttgaaaagacaccacaattgaaggaacgctacaaacgtttgttcaccaaggagcttttcaaagcaggaaaagataagggtgaccttgagaaatggttgatcaaccatgattcggaaccgaataaggccgagaaaatttcctggattcatcagtttgagaatttcactacgtactttcaaggtttctacgaaaatcgtaagaatatgtattccgatgaggtcaagcacacggctatcgcctaccgtttgatccacgaaaacttgccgcgtttcgttgacaacatccaggtccttagcaagattaaatcagactatcccgatctttaccatgaattgaaccatctggattctcgcactattgactttgcagattttaagttcgacgacatgcttcagatggatttttaccaccacttgcttatccagtctgggattacggcgtacaacactttattgggcggaaaggtattagaaggaggaaaaaagctgcaaggtattaatgaacttattaatctgtatgggcagaagcataagatcaagattgctaagctgaagccgctgcataaacagattttgagcgatggacagtccgtaagttttcttccgaagaagttcgataacgattatgaattgtgtcagactgtgaaccacttctatcgcgagtatgtagctatctttgacgaattagtggtcttgtttcaaaaattttatgactatgataaggacaacatttacatcaaccatcagcagttaaaccaattaagtcatgaacttttcgcagattttcgtctgttgtcccgcgcattagacttttattactgtcaaatcattgacggcgatttcaataacaaaatcaataacgctaagtctcagaacgcgaaggaaaagctgcttaaagagaaagagcgttataccaaatcaaatcactccattaatgagttgcaaaaggctatcaatcattacgcatctcaccacgaggacactgaggtaaaggttatttcagactatttctccgctacgaacattcgtaacatgatcgacggtattcaccaccatttttcgactatcaagggcttcttggaaaaggataataaccaaggcgaaagctaccttcccaagcagaaaaatagtaatgatgtgaaaaatttgaagctgtttcttgacggggtattacgcttaattcactttattaaacccttggccttaaaatcagacgacactctggaaaaagaagaacatttttatggggaatttatgcccctgtatgacaaattagtcatgtttacgcttttatacaataaggtacgtgattatattagtcaaaagccatacaatgatgaaaaaattaagctgaactttgggaatagcactctgctgaacggctgggacgtcaataaggaaaaagataatttcggggtaattttatgcaaggagggtctgtattatctggccatcttagataaatcccacaaaaaggtgtttgataacgctccgaaggcgacctcctctcatacctatcagaaaatggtttacaagcttctgcccggaccgaacaagatgttaccgaaggtcttcttcgctaaatccaacattggttactatcaaccttctgctcagctgcttgaaaactacgaaaaaggcacccataagaagggttcgaacttcagcttaaccgactgccaccacttaatcgactttttcaaatcgagtatcgccaaacacccagaatggaaggaatttggattccgcttttcggacacccacacataccaagacctttccgacttttacaaggagattgaaccccaatcttacaaagttaagttcattgatatcgacgcagactacatcgatgatcttgtggaaaagggtcaattatacctgtttcagttgtacaataaagacttctccaaacaatcttacggaaagccaaacttacacacgttatactttaagtcacttttctccgatgataatctgaagaacccaatctacaaattgaatggagaggctgaaattttctatcgtcgtgcttccttaagtgtgtctgatacaactatccatcaggcgggagagattttaacacctaaaaaccccaacaatacacacaatcgcaccttatcctacgatgttattaaaaataagcgttatacgactgacaagtttttcttgcacattcccatcactatgaatttcggcatcgagaatactggctttaaggccttcaatcaccaagttaacacaacactgaaaaatgccgacaaaaaagatgtgcacatcattggaattgaccgtggagaacgccacctgctgtatgtttctgtcattgacggggacggacgcattgtggaacaacgtaccctgaatgacattgtttcaatttctaataacgggatgagcatgagtaccccctatcaccagatcttagacaaccgcgaaaaagaacgcttagcagcacgtactgattggggcgacatcaagaacattaaggagcttaaagctggttacctttcacatgtggtacatgaggtggttcaaatgatgcttaagtataatgcgatgattgtgctggaggatttaaattttggatttaaacatggtcgcttcaaggtggaaaaacaagtgtatcagaatttcgagaatgcactgattaagaaacttaattatttagtccttaaaaacgccgacaatcatcaactgggaagtgtccgcaaagccttacaactgaccaataattttacggacattaagagcatcggcaagcagaccggttttattttctatgttcctgcctggaatacatccaagattgatccgaccactggcttcgtggacctgcttaagcctcgctacgagaacatggcacaggcacagtcttttatctcgcgcttcaagaagatcgcctataatcatcaactggactattttgaatttgagtttgactacgctgatttctaccagaagacgatcgataagaaacgtatttggacactgtgcacatatggtgatgtacgttattattacgatcataagactaaggagactaagacggtgaacatcacgaaagaacttaaatcgctgctggataaacacgatttgtcttaccagaacgggcataacttagtcgatgaattggctaactcccatgacaagtctctgttgagtggcgttatgtacttgcttaaagttttattagcacttcgttacagtcatgcccaaaagaacgaggacttcattttatccccggtaatgaacaaggatggcgtgttcttcgactcacgttttgcggatgacgtcctgccgaacaacgctgatgccaacggtgcgtatcatatcgccttaaaggggttgtgggtgttgaaccaaatccaatccgctgataatatggataaaatcgatctgtcgatttccaacgagcaatggctgcattttacgcagtcgcgctaa

SEQ ID NO: 904 - DNA, 3786 bp, synthetic construct
  misc_feature 1..3786: note = Description of Artificial Sequence: Synthetic polynucleotide
  source 1..3786: mol_type = other DNA
atgaatactagcctgttcagctcattcactcgccaataccccgttacgaaaactttacgttttgaattgaagccaatgggagctactttaggacatatccagcagaagggattcttacataaggatgaagaattggcaaaaatttataaaaaaatcaaggagctgttggatgagtaccatcgcgccttcattgcggataccttgggggacgcacaactggttgggcttgacgatttttacgccgactaccaagcgcttaaacaagatagtaaaaattcccatcttaaggacaagctgaccaaaactcaggacaacttacgtaagcaaattactaagaatttcgagaaaactcctcagctgaaagagcgttataaacgtcttttcacgaaagaattatttaaggcagggaaagataaaggggatttggagaagtggttaatcaaccatgatagcgaacctaacaaggctgaaaagatttcgtggatccatcaattcgaaaatttcaccacatatttccagggtttctacgagaatcgcaagaatatgtactccgatgaagtgaagcatactgctattgcttaccgcttgattcacgagaatttgccgcgctttgttgataacatccaggtgctgtcgaagattaaatccgattatccagacctgtaccacgaactgaatcacttagatagccgcacaatcgactttgctgattttaaattcgatgatatgcttcaaatggacttttaccaccacctgttaattcagagtggtatcaccgcttacaatacattacttggcggtaaagtgttggaagggggaaagaagctgcaggggatcaatgagttaatcaatttatatggtcaaaaacacaaaatcaaaatcgctaaactgaaacccttacataagcagatcctgagtgatggtcaatcggtgtcatttttaccgaaaaaatttgacaatgactacgagctgtgccaaacagtgaaccatttctatcgcgaatacgtggctatctttgacgagcttgtggtattgttccagaagttttacgattacgataaggacaatatctatatcaaccaccagcagttaaaccaattatcccacgaattatttgctgattttcgtttactgagtcgcgccctggacttttactattgccagattattgatggagattttaacaacaaaatcaacaatgcaaaaagccagaacgcgaaagagaagcttctgaaggagaaagagcgctacacaaagtcaaatcatagtattaatgagctgcagaaggcgattaatcactacgctagccatcatgaagatacagaagtcaaggtaatcagcgactacttctctgccacaaacattcgtaatatgatcgatggcatccatcaccatttctccacaatcaagggttttttggaaaaagataataatcaaggggagagctacctgccgaagcaaaagaattcgaacgacgtaaaaaacttaaaactttttttagacggtgttctgcgcttgatccacttcatcaagccgcttgcacttaaatctgatgatacgctggaaaaagaagaacacttttatggcgaatttatgccattatatgataagcttgtcatgtttacacttttgtataacaaggtgcgcgattacatttcacaaaaaccttataacgacgagaaaattaagttgaattttggtaatagtactttacttaacgggtgggatgttaataaagaaaaagataacttcggtgtaattctttgcaaggaaggactgtattatttggccattttggacaagtcccataagaaggtcttcgacaacgcgcccaaggcgacctcgagccatacttatcagaaaatggtctacaaacttttgccgggacccaataaaatgctgccaaaagtattttttgcaaagagtaacattggatattatcagcccagcgcccaacttttagagaattatgagaaagggacccacaaaaagggctctaatttctcattgacggactgccaccatttgattgatttttttaaaagtagcattgccaaacatcctgaatggaaagaatttggtttccgcttttctgacacacacacttaccaggacttatcagatttttataaggaaattgaacctcagtcttacaaagtgaaatttattgacatcgatgctgactacattgatgacttagttgaaaagggccaattgtatttgttccagttatataacaaggacttttcgaaacaatcatacggtaagccgaatttgcacactttgtattttaagtccttgtttagcgatgataatctgaaaaatccaatctacaaattgaacggggaggcagagattttttaccgtcgcgctagcctgtccgttagcgatacaactattcaccaagcaggagaaatccttacgcctaagaatccgaataacacgcacaatcgtactttaagttatgatgtaatcaaaaataaacgttataccacagataaatttttcctgcatatcccgatcacaatgaatttcggaatcgaaaatactggcttcaaagccttcaaccaccaagtgaataccacattaaagaatgctgacaaaaaagacgttcacattatcggaatcgaccgcggcgagcgtcatttactgtatgtcagtgtgattgacggggatggccgtattgtagagcagcgcactcttaacgatattgtgtcgatttccaataacgggatgtctatgtcgactccttatcaccagattttggataatcgtgaaaaggagcgccttgcggcccgtactgattggggtgatatcaagaacatcaaagaattgaaggcagggtacttatcacatgtagtgcatgaagtggtccagatgatgcttaaatacaatgcaatgattgtattggaagatttaaatttcgggtttaagcacggccgtttcaaggtggaaaagcaggtctatcaaaacttcgaaaatgccttgattaagaagctgaactatcttgtactgaaaaacgcggataatcaccaattgggctcagtccgtaaagccctgcagcttaccaacaactttaccgatattaaatctatcggcaagcagaccgggtttatcttttacgtgcctgcatggaatacctccaaaatcgaccccaccacgggctttgttgacttattgaaaccacgttatgagaacatggcgcaagcgcaatcttttatttcacgtttcaaaaaaatcgcctataatcatcaacttgattactttgagttcgaattcgattacgctgatttttaccaaaaaacaattgataagaaacgcatctggaccttgtgtacttacggtgatgtacgctactactacgaccacaaaacgaaggaaaccaaaactgtcaacattactaaagaactgaagagtttattggacaagcatgatctttcataccaaaatggccacaatcttgtagacgaacttgctaacagccatgataaaagtttattaagcggggtgatgtaccttctgaaagtgcttttagctttacgctattcacacgcccaaaagaatgaggatttcattctttcacctgttatgaataaggacggtgttttcttcgactcgcgttttgcagacgacgtactgccaaataatgctgacgctaatggagcttaccacattgctctgaaagggctttgggttcttaaccaaattcaaagtgcagataatatggataagattgatctttcaatcagtaatgagcaatggctgcacttcacccaaagccgctaa

SEQ ID NO: 905 - DNA, 3786 bp, synthetic construct
  misc_feature 1..3786: note = Description of Artificial Sequence: Synthetic polynucleotide
  source 1..3786: mol_type = other DNA
atgaacacgtcactgttttcttctttcacgcgccaataccctgtcacaaagacgcttcgcttcgaattaaagcctatgggggcaaccttaggacacattcaacaaaaagggtttctgcataaagacgaagaattggctaagatctataaaaaaattaaagagttactggacgaatatcatcgcgcgttcattgctgatactttgggggatgcgcaattagtcgggttagacgatttttacgcagattatcaagcgctgaagcaggactcaaagaactcccacttaaaagataaattaactaaaacccaagataacttgcgcaagcaaattacgaaaaacttcgagaagacaccacaattgaaagaacgctataagcgtttgttcaccaaggaattgttcaaggccggaaaggataagggtgatcttgagaagtggttaatcaaccacgactcggaaccgaataaagctgaaaagatttcatggattcaccaattcgagaacttcacgacctatttccaaggattctacgagaatcgcaaaaatatgtacagtgacgaggtcaaacatacggccattgcatatcgccttattcacgagaaccttccgcgcttcgtcgacaacatccaggtcttatcaaaaattaagtccgattaccctgatctgtatcatgagttgaaccacttggatagtcgcacaatcgacttcgcagatttcaaattcgatgacatgcttcaaatggacttctaccatcatttgttaatccagagtgggattaccgcctacaatacgttattgggtggaaaagtccttgagggaggaaagaagttacagggaatcaatgaattaatcaatctgtacggacagaagcacaagattaagatcgcgaagttgaagccgttgcataaacaaatcttgtccgacgggcagtccgtctcgtttttaccgaaaaaattcgataacgactatgagttgtgccaaactgtgaatcacttctatcgcgaatatgtagcaatctttgatgagcttgtggtattattccagaaattttacgactacgacaaagacaatatctatatcaaccatcaacagttaaaccagctttctcatgaactttttgccgattttcgtttactttcgcgcgccttagacttctattactgtcagattattgatggtgacttcaataataagatcaataacgctaaatcgcagaatgccaaagagaagctgttaaaggagaaagagcgttatacgaaatcaaatcactcgatcaacgagttacaaaaagccattaatcattatgcaagccaccacgaagacacggaagttaaagtaatttcagattatttctccgccactaacatccgcaacatgatcgatgggatccatcatcatttctctactatcaaggggtttctggaaaaagataacaatcaaggggaatcctatctgcctaagcagaagaatagtaatgatgtaaaaaatttaaagctttttctggacggagtcttgcgtttgattcactttattaagccgctggctcttaaatctgatgatacccttgagaaagaagagcacttttatggcgagttcatgccattatatgacaaattagtgatgttcacgcttttgtacaataaagtgcgcgactacatttcccagaaaccatacaacgatgaaaaaattaaactgaattttggtaattcaacgcttttaaacggctgggatgtgaataaggaaaaggataattttggtgtgatcttgtgtaaggaggggttatactacttagcgatccttgataaaagtcacaagaaagtgtttgacaacgcgccaaaagctacatcttctcatacctaccagaagatggtctacaagctgcttcctggaccgaacaaaatgctgcccaaggtcttttttgcgaaatccaacatcggctactaccagccgtctgcgcaacttttggagaactacgagaaagggacccacaaaaaagggtcgaatttctcgcttaccgattgtcaccatttgatcgacttcttcaaaagttcaatcgcgaaacaccccgaatggaaagagttcggcttccgcttctccgacacacatacctatcaggaccttagcgatttttataaggaaattgaaccccaaagctataaagtcaagttcattgacatcgatgcggactacatcgacgaccttgtagaaaagggtcagctttatctgtttcagctgtataacaaagacttttcgaaacagtcctatgggaagccaaacttgcatactttatatttcaaatcgctgttttccgatgataatttgaagaaccctatttataaattgaacggagaagccgaaatcttctaccgtcgtgcgagcttgagtgtctctgacacaacaattcatcaagcaggtgagattttgacgcccaagaatcctaataatacgcacaaccgtacgttaagttatgacgtgatcaaaaacaagcgttacacgacggataaattctttctgcatatcccgatcacgatgaactttgggattgagaacactgggtttaaggcattcaatcatcaggttaataccacattaaaaaacgcggacaagaaagatgtacatattattggtattgatcgcggggaacgccatttgctgtacgtttctgtaattgacggggacggacgcatcgtggaacaacgcacccttaacgatattgtatctatctcgaacaatggtatgtctatgtcgacaccgtatcaccaaattctggataatcgcgaaaaggaacgcttagcggctcgcactgattggggggacattaaaaatatcaaggagttaaaggctggctacctgtcccacgtggtgcacgaggtagtacaaatgatgttaaagtacaatgccatgattgttttagaggacttgaactttgggtttaagcatggtcgctttaaggttgaaaaacaagtataccagaacttcgagaatgctttaatcaagaaacttaactaccttgttctgaaaaacgcagataatcatcaacttggctcggtacgtaaagccttgcaattgaccaataacttcacagacatcaagtcgatcgggaaacagacgggatttattttttacgttcccgcgtggaacaccagtaagattgacccgacgactggttttgtagacctgctgaaaccacgctatgagaatatggcacaagctcagagttttatttctcgcttcaagaagattgcttataaccatcagctggattatttcgagttcgagtttgattacgcggatttctatcaaaaaactatcgacaaaaagcgcatctggaccttgtgtacgtatggtgatgttcgttattactatgaccacaaaaccaaagagacaaagactgtgaacatcacaaaagaattaaaatcgttacttgataagcacgatttgtcatatcaaaacgggcataaccttgtggatgagttggcaaattcacatgataaatccttattatcaggggtgatgtatttacttaaggttttactggctttacgttatagccacgcacaaaagaatgaggacttcatcttgagtcccgtaatgaacaaggacggtgtatttttcgactctcgcttcgccgacgacgttcttccgaataatgctgacgccaacggagcataccatatcgcgttaaaggggttgtgggtattgaatcagatccagtcggctgacaatatggataaaattgatctttcaatctccaatgaacaatggctgcactttacccagtcacgctaa

SEQ ID NO: 906 - DNA, 3867 bp, Coprococcus sp.
  source 1..3867: mol_type = genomic DNA
atggtaggtaataaaatatcaaattcgtttgattcgtttactggaatcaacgcattaagtaaaacgttaagaaatgagttaattccatcagattatactaagagacatattgctgagagtgattttattgcggctgatacaaacaaaaatgaagatcagtatgtagcaaaagaaatgatggatgattattatcgcgattttataagtaaggttctagataatttacatgatatagaatggaaaaatttgtttgaattaatgcataaagcgaaaatagataaaagtgatgcaacttcaaaagagttgataaaaattcaggatatgcttcgtaaaaaaataggaaaaaaattctctcaagatcctgaatataaagtcatgctcagtgctggtatgataacaaagattttaccaaaatatatattggagaaatatgaaactgatagagaagacagattagaagcaataaaaagattttacggattcacagtttattttaaagaattttgggcaagtagacaaaatgtattttctgataaggcaatagcgtcatctatatcatatagaatcatacacgagaatgccaaaatatatatggataacctggatgcttataatagaataaaacagattgcttgtgaagaaattgagaagattgaagaagaggcatatgattttctgcaaggtgaccagttagatgtggtatataccgaagaagcatatggacgatttatatcccagagtggaatagatttatataataatatatgtggggttattaatgctcatatgaatttatattgccagagcaaaaaatgctccagatcaaagtttaaaatgcaaaaattacataaacagattttatgtaaagcagaaaccgggtttgaaattccattaggctttcaagatgatgcgcaagtgataaatgcgattaattcatttaatgctctaataaaagaaaaaaatattatatcacgtctcagaactatagggaaaagcatatctttatatgacgtaaataagatatatatttcatctaaagcgttcgagaatgtctctgtatacattgatcataaatgggatgtgatagcttcaagcttgtataagtatttctcggaaattgtcaaaggaaataaagacaacagggaagaaaagattcagaaggaaattaagaaagtaaagagctgtagtctgggtgatttgcagagactggttaattcatattataaaatagatagcacatgtttggagcatgaagtaactgaatttgttactaaaataatagatgagatagataactttcaaattacggattttaaatttaacgacaaaattagcttgattcaaaatgaacagattgtcatggatataaaaacatatcttgataaatatatgagtatttatcattggatgaaatcgtttgtgattgatgagctagttgataaggatatggagttttattcagaacttgatgaacttaatgaggatatgtcggaaattgtgaatttatataacaaagtgcgtaactatgttacacagaagccttatagtcaggaaaagataaaattgaacttcggatcaccgactcttgccgatggatggtcgaaatcaaaggaatttgataacaatgctattatattgattcgtgatgaaaaaatatatttggcaatatttaacccaagaaataaaccagctaagactgttatatcaggacacgatgtttgcaattctgaaacagattataagaaaatgaattattatttgctccctggggcaagtaagactttaccacatgtgtttattaagtctagattgtggaatgaatcacatggaatacctgatgaaatattgcggggatatgagttgggtaaacacttgaaatcatcggtaaattttgatgtagaattctgctggaagctaattgattattataaagaatgtataagctgttatccaaattataaggcgtataattttaaatttgctgatacagaatcgtacaatgatatatcagaattctatagagaagtggagtgtcagggatataagattgactggacatatataagttcagaagatgtagaacaacttgatcgtgatggtcaaatatatctgtttcaaatctataataaagactttgcaccgaatagtaaaggaatggataatcttcatacgaagtacctcaaaaatatatttagcgaagacaatcttaaaaacatagttataaaattgaacggagaggcagaattattttatagaaaatcaagtgtcaagaaaaaagtagaacataaaaagggtacgattttagtcaataaaacatataaggttgaggataacactgaaaacagtaaagaaaaaagagttattattgaatcagtaccagatgattgctatatggaacttgttgattattggagaaatggtggtatcggaattctttcagacaaagctgttcaatataaggacaaagtatctcattatgaagctactatggatatagtcaaggatcgcaggtatacagtagataagttttttatacatttgcctataactatcaatttcaaagcagatggaagaattaatataaatgaaaaggtactcaagtatatagcggaaaatgatgagcttcatgtgattggaattgatagaggagaaagaaatctcctttatgtgtcagtaattaataaaaagggaaagattgttgagcagaagtctttcaatatgatagaaagctatgaaactgtaacaaatatagttagaagatataattataaagacaaactggtcaacaaagaaagtgcccggacagatgcgagaaaaaattggaaagaaattggaaagataaaagaaataaaagagggatacttgtcacaggtaattcatgaaatatcgaagatggtgttgaaatataatgcaatcattgttatggaagatctaaattatggatttaaacgaggtaggtttagggttgaacgtcaggtataccagaaatttgagaatatgttgatatctaaactggcatacttggtagataaaagtcgaaaagccgatgaaccaggaggtgtactaagagggtatcagcttacgtatattccagattctttagagaaacttggtagccagtgtggaatcatattctatgtacctgctgcgtatacatctaagattgatccgttaacaggctttgtaaatgtattcaattttagagaatattctaattttgaaacaaaattggattttgttagatcattagacagtatacgatatgatacagagaagaaattgttttcaatatcatttgattatgacaactttaaaacacataataccactctggcaaaaacgaagtgggttatatatttacgaggcgagcgtataaaaaaggaacatacatcttacgggtggaaggatgatgtttggaatgtggaaagtagaattaaagacttgtttgacagttcacatatgaaatacgatgatggacataatttaattgaagatattcttgaattagaatcgagtgtacagaagaagctgatcaatgaattgatagaaataataaggttgactgttcaacttcgtaacagtaagtcagagagatacgataggacagaagctgaatacgacagaatagtatcgccagttatggatgaaaatggacggttttatgattcggaaaattatattttcaatgaagaaacagagttaccaaaggatgcagatgctaatggtgcatattgcattgcattaaaaggtctgtacaatgtcatagccataaagaataactggaaagaaggagagaaattcaacagaaaattgttaagtctaaataattataactggttcgattttatacaaaatagaaggttttaa

SEQ ID NO: 907 - DNA, 3867 bp, synthetic construct
  misc_feature 1..3867: note = Description of Artificial Sequence: Synthetic polynucleotide
  source 1..3867: mol_type = other DNA
atggtaggcaacaagatctcaaacagttttgacagctttacaggcatcaacgcgttgagcaagacccttcgcaatgaattaatcccatctgattacactaaacgccacattgcagaaagtgactttattgctgccgatactaataaaaatgaagatcaatacgttgctaaggagatgatggatgactattaccgcgattttatttctaaagtattggataacttacacgacattgagtggaaaaatttgtttgaattgatgcacaaggccaaaattgataagagcgatgctacttcaaaagagttgattaaaatccaagatatgttgcgtaagaagattggtaagaagttctcgcaggaccctgagtacaaagtgatgttatcggctggcatgattacaaagattcttcctaagtatatcctggagaaatacgaaacggaccgtgaggatcgcttggaagcaatcaaacgcttctacgggttcaccgtgtattttaaggagttctgggcgagtcgccaaaatgtcttctctgacaaggcaatcgcatcatctatcagctaccgcatcattcacgaaaatgccaaaatttacatggacaatttggatgcatacaatcgtatcaaacaaattgcctgcgaggaaattgagaagattgaagaagaggcatatgactttctgcaaggagaccaacttgacgtggtgtatactgaggaggcgtatggtcgttttattagtcaaagtggtattgatttgtataacaatatttgcggcgtaatcaatgctcatatgaacttgtactgccaaagcaagaaatgttcgcgcagtaaatttaagatgcaaaagttacataagcaaattttgtgcaaggcggaaaccggttttgaaattcccctgggatttcaggacgatgctcaggtcattaatgcgatcaattcgtttaatgcgttaatcaaggaaaaaaatatcatctcccgccttcgtacaattggtaaatcgattagcctgtacgatgttaataaaatttacatttcctcgaaagcatttgaaaatgtttccgtctatattgaccacaaatgggatgtgattgctagttctttgtacaaatacttttcggaaattgtgaaggggaacaaggacaaccgcgaagaaaaaattcagaaggagatcaagaaggtaaagagttgcagcctgggggatttgcagcgcttggttaattcctactacaagattgattccacttgccttgagcacgaggtcacggaattcgtcaccaaaatcatcgacgagatcgacaatttccagatcacagactttaagtttaatgacaaaatttcgctgattcagaatgaacagattgtgatggatattaagacgtatcttgataagtacatgtcaatctatcattggatgaaatccttcgttatcgatgagctggtagataaagatatggagttttattcagagttggacgaactgaacgaggacatgtcagaaatcgtcaatttgtataataaggttcgtaattatgttacgcaaaagccctactcgcaagagaagattaaattaaatttcggatcgcccaccttggctgacggatggtcgaaaagtaaagaattcgacaataatgctattattttgattcgcgatgaaaagatttatcttgcgatctttaaccctcgtaataagccggcgaagacagttattagtggccatgacgtgtgtaactctgagacggattacaagaagatgaactattatttattaccgggggcatctaagaccttaccgcatgtcttcatcaaatcgcgtctgtggaatgaaagtcacggtatcccagatgaaatccttcgtggctatgaattagggaaacacttaaagtcgtccgttaactttgatgtcgagttttgttggaagcttattgactactacaaggagtgtatctcgtgctatcctaactataaagcgtacaacttcaagttcgcagacaccgaatcctacaacgatatcagcgagttctatcgtgaagtagagtgccaaggatacaaaattgactggacgtacatttcttccgaggatgttgaacagttagatcgtgacgggcaaatttatttattccaaatttataacaaagacttcgctcccaattctaaaggtatggacaacctgcacaccaagtacttgaaaaatattttttcagaggataacttgaagaacattgttattaaactgaacggtgaagccgaattattctatcgcaaatcgagtgttaagaaaaaggtagagcacaagaaggggaccatcttggtaaacaagacatataaagttgaagataacactgagaactcgaaggagaagcgcgtgattattgagtctgtccctgatgattgctatatggaactggtggactactggcgtaacggcggcatcggtattttgagtgataaggctgttcagtataaggataaggttagccattatgaagcaactatggatatcgtcaaagaccgccgttatacagttgataaattctttattcatctgcctattactatcaacttcaaggcggatggtcgcatcaatattaacgaaaaggtgttaaagtatatcgccgaaaacgatgagttgcacgtaattgggattgaccgcggcgaacgcaacctgctgtatgtgtccgtgattaacaaaaaggggaaaatcgtagaacagaagagctttaatatgatcgaatcgtacgaaactgtcacaaatattgtgcgccgctataattacaaggacaaacttgtgaataaggaatccgcccgtacagacgcacgcaagaattggaaagaaattggaaagatcaaggaaattaaggagggatacttgagtcaggtgattcatgagatcagcaaaatggtccttaagtacaacgccatcatcgtaatggaagacttgaactacggatttaagcgcgggcgctttcgtgttgaacgccaggtatatcaaaaatttgagaatatgttgatctctaaacttgcttatcttgtcgataagagtcgcaaggctgacgaaccaggtggggtcctgcgcggataccaactgacctatatcccggactctctggaaaagttaggaagtcagtgcggcattatcttttacgttcctgcagcttatacgagtaaaattgatccactgactgggttcgtaaatgtctttaacttccgtgaatattcaaattttgaaacgaaactggattttgtccgctccttggattctatccgctacgacacagagaaaaagttgttttcaattagttttgattacgacaactttaaaactcataacactaccttagccaagacaaaatgggttatctaccttcgtggcgaacgcattaaaaaggaacatacctcctatgggtggaaggacgacgtttggaacgtggaaagccgtattaaagatctgtttgatagctctcacatgaagtacgacgacgggcataaccttattgaggatatcttggaactggagtcgtccgtacaaaagaagctgattaacgagctgattgaaattattcgccttacggttcaattacgcaactctaaatcggagcgttacgatcgtaccgaggcagagtatgatcgtatcgtgagtcctgttatggatgagaatggccgtttttatgattctgaaaactacatctttaatgaagagactgagcttcccaaggacgcagatgctaacggcgcctattgcatcgctttaaagggtttgtacaatgttattgctattaagaacaattggaaggaaggagaaaaattcaaccgcaaactgctttctttgaacaactacaattggtttgattttattcagaatcgtcgtttttaa

SEQ ID NO: 908 - DNA, 3867 bp, synthetic construct
  misc_feature 1..3867: note = Description of Artificial Sequence: Synthetic polynucleotide
  source 1..3867: mol_type = other DNA
atggtgggtaacaagatcagcaattcctttgacagtttcactggaatcaacgccctttccaaaacactgcgtaacgaattgatcccgtcggactacaccaagcgtcatattgctgaatcggattttatcgctgcagacaccaataagaatgaagaccagtatgttgcaaaagagatgatggatgattattaccgcgatttcatttctaaagtcttagataatcttcatgatattgaatggaagaacctgttcgaattaatgcacaaagccaaaatcgacaaatccgacgcaaccagtaaagaactgatcaagatccaagatatgttacgcaagaagattggaaagaaattttctcaagacccagagtacaaagtgatgttgtccgctgggatgatcactaagatcttgcctaaatacatcctggaaaagtatgagaccgaccgcgaggaccgtcttgaagcaatcaagcgcttttatggtttcaccgtctacttcaaggaattttgggcgagtcgtcaaaacgtatttagcgataaggctattgcctcatctatttcttatcgcatcattcatgagaatgccaagatctatatggacaaccttgatgcatataaccgtatcaaacaaatcgcatgtgaggagattgagaagatcgaagaggaagcctacgatttcttgcaaggagaccaacttgatgtagtttacaccgaggaggcatatggacgctttattagtcagagcggtattgacctgtacaataatatctgtggtgttatcaatgcgcatatgaatttgtattgccagtctaaaaagtgttcgcgctcgaaatttaaaatgcaaaagttacataagcaaattttgtgcaaggccgagacgggtttcgagattccgttagggtttcaggacgacgcccaagtgattaacgccatcaattcgttcaacgctttgattaaagaaaaaaatatcatctcgcgcttgcgcacgattgggaagtctatctctttatacgacgtaaataagatctatatctcttctaaagcttttgaaaacgtgtccgtttacattgatcacaaatgggatgtaattgctagttccctttacaagtacttctccgaaatcgttaaaggtaacaaagacaaccgtgaagaaaaaatccaaaaagagattaagaaagttaagtcatgttccttaggcgacctgcaacgcttagtgaacagttattacaaaattgattctacatgtttagagcacgaggtcacagaattcgttacaaagattattgatgagattgacaactttcaaattacagactttaagtttaatgacaagatttctttaatccagaacgaacagatcgttatggacatcaagacttatcttgataaatatatgtcgatttatcattggatgaaaagttttgttattgacgagctggtggataaggatatggaattttattctgagcttgacgaactgaatgaggatatgtcggaaatcgtcaatttatacaataaagttcgcaattatgtaacccagaaaccctactcccaagagaaaatcaaacttaacttcggcagccccacgctggcggacgggtggagtaaatcaaaagagtttgacaacaatgcgatcatccttatccgtgacgaaaaaatttaccttgcgattttcaaccctcgcaataagcccgccaaaaccgtgatcagtggtcatgatgtctgtaattctgagactgattataaaaaaatgaattactatctgctgcctggtgcaagcaaaacgctgccgcacgtcttcattaagtcccgcttatggaacgagtcgcatggtattcctgatgaaatcttacgcgggtacgaactgggcaaacatcttaaaagcagcgttaatttcgatgtagagttctgttggaagctgatcgactactataaggaatgcatttcgtgttaccccaactacaaggcgtacaactttaagttcgcggacacagaaagttataacgatattagcgagttttaccgcgaagttgagtgccagggatataagattgactggacttatattagtagcgaagacgttgagcaactggaccgtgatgggcaaatctacttgtttcagatttacaacaaggacttcgctcccaactcgaaaggtatggacaacctgcacacgaaataccttaaaaatattttttccgaagataacttaaagaatattgtcattaaactgaatggcgaagctgagttattttaccgtaagtcatccgtcaaaaagaaggtcgaacataaaaagggaacaatccttgtaaataagacgtataaggttgaggacaataccgagaattcgaaggaaaagcgtgtgatcattgaatcggtgccggacgattgctacatggaattagtggactactggcgtaacggtggcatcggcatcctgtcagacaaggcggtgcagtataaggacaaagtctcgcactatgaagccaccatggacattgtaaaggaccgtcgctacacggtggataagttctttatccatttgcctatcacgattaattttaaagcagatggtcgtatcaacattaacgaaaaggtgttaaaatacattgctgagaatgacgagttacacgttatcggaatcgaccgtggtgagcgtaaccttttatatgtctcagtaatcaataaaaaagggaagattgttgagcagaaaagcttcaatatgatcgaatcttacgagaccgtgacaaacatcgtgcgtcgttacaactataaagataagttggtaaataaggagagtgcccgcaccgacgcacgcaaaaactggaaagaaatcggcaagatcaaggaaatcaaggaggggtatttgtcacaagtaatccacgaaatttctaaaatggtattaaagtacaacgcaattatcgtcatggaagatttgaactacggcttcaagcgcggccgtttccgcgtcgagcgtcaagtatatcagaaattcgagaatatgttaatttccaagttagcatacttagtagataaaagccgcaaggctgatgaaccaggtggggttctgcgcggctaccaattaacgtacattcccgattccttagaaaagttgggctctcagtgcggtattattttttacgtccccgcagcatatacatcgaagatcgatccgcttaccggatttgtcaatgtctttaattttcgcgaatactctaatttcgagacaaagcttgacttcgtgcgcagtttggacagcattcgctatgatacggagaagaaacttttttcaatctcttttgactatgataatttcaagacccacaacacaacactggccaaaaccaagtgggtaatctacctgcgtggggagcgtatcaagaaggagcacacgtcgtatggatggaaggacgacgtatggaatgtggagtcacgtattaaggacctgtttgacagttcccatatgaaatatgacgacggccataaccttatcgaagacattcttgagttagagagtagcgtccaaaagaagttaatcaatgaacttatcgagatcatccgccttactgtgcagttgcgcaattccaagtcggaacgctacgatcgtacagaggccgaatacgatcgcatcgtctcccccgtaatggatgaaaacgggcgcttttatgattccgaaaactatattttcaacgaggaaacggaacttccaaaagacgcggacgccaacggtgcatactgcatcgccctgaagggcctgtataatgttatcgccattaagaacaattggaaagaaggtgaaaagttcaaccgcaaattactgtccctgaacaattacaactggttcgactttatccaaaatcgtcgtttctaa

SEQ ID NO: 909 - DNA, 3867 bp, synthetic construct
  misc_feature 1..3867: note = Description of Artificial Sequence: Synthetic polynucleotide
  source 1..3867: mol_type = other DNA
atggttggtaataaaatcagtaattcttttgattccttcacaggtattaacgctttgtctaagactctgcgcaacgagcttattccgagtgattatacaaaacgtcatattgcggaaagtgacttcattgctgcggatacaaacaaaaacgaagatcaatacgtggcaaaagaaatgatggacgattactatcgtgactttatctcgaaagtactggacaatttgcacgatattgagtggaaaaatctgttcgaactgatgcataaagcgaaaattgacaagtctgacgccacatcgaaagaactgatcaagattcaggacatgcttcgcaaaaagattggcaaaaaatttagtcaagacccggagtacaaagtgatgttgtccgcggggatgattaccaagattcttcccaaatacattttggaaaaatacgagaccgaccgcgaggaccgtcttgaagcaattaaacgtttctacggctttactgtttacttcaaggagttttgggcgagccgtcaaaatgtgttctcagacaaagctattgcctcgtcgattagttatcgcattattcatgaaaatgcaaagatctacatggacaacttagatgcctacaatcgcattaaacaaatcgcttgcgaagagattgaaaagattgaggaagaagcatatgacttccttcagggcgatcagcttgacgtcgtgtacactgaggaggcatatggacgcttcatcagccagtctgggattgatctgtacaataatatctgtggtgtcatcaatgctcatatgaacttgtactgccagtcgaagaaatgtagtcgctctaaattcaaaatgcaaaaactgcacaagcagattctgtgtaaggcagaaaccgggttcgaaatcccgctgggttttcaagatgacgctcaggttattaacgcgattaattcgttcaacgcacttattaaagaaaaaaatattatcagtcgcctgcgcactattggcaaatctatcagtttgtacgacgtaaataagatttacatcagctctaaagcgttcgaaaacgtgtccgtatatattgaccacaaatgggacgtgattgcgtcctcgttatacaaatatttttcggaaatcgtcaaagggaacaaggacaaccgtgaagagaagatccagaaggagattaagaaagttaaaagttgttccttgggggacttacagcgtttagtgaactcttattataaaattgattccacgtgcctggagcacgaagtaaccgaattcgtgacgaagatcattgatgaaattgataacttccagatcaccgactttaagtttaacgacaagatctctctgattcaaaacgagcagattgtgatggatatcaagacctatttagacaagtatatgtcgatctatcactggatgaaatcgttcgtcatcgacgaactggtcgacaaggatatggagttttactcagagttagatgaattgaacgaagacatgtctgagatcgtaaatctgtataacaaagtacgcaactacgttacccaaaaaccgtactcgcaggaaaagattaaactgaattttggaagtcccacactggcagacggatggtctaaaagtaaagaatttgataataacgcgatcattcttattcgcgatgaaaaaatttatttagcaatctttaatccacgtaataagccggccaagacggtgatctcgggccatgacgtttgcaattcggaaacagattacaaaaagatgaattattacttactgcctggtgcgtcgaagacgttaccgcacgtctttatcaagtctcgtctgtggaacgagtcccacggtatcccagacgagatcctgcgcggttatgagctggggaaacacctgaaatcatccgtaaattttgacgtcgagttttgctggaaacttattgactactataaagagtgcatctcttgttatccgaattataaagcatacaactttaagttcgctgatacagaatcctacaacgacatcagcgaattctaccgcgaagttgagtgccaggggtataagattgactggacatatattagctcagaagacgttgagcagttggaccgtgatgggcagatctatttgttccagatctataacaaagattttgcgccgaattcaaagggcatggataatcttcacacgaaatacctgaagaatattttctctgaagataatttgaagaacatcgtgatcaagcttaatggcgaagcagaattattctaccgcaaatccagcgttaaaaagaaggtggaacataaaaaaggtacgatccttgttaataagacttataaagttgaggataataccgagaactctaaagaaaagcgcgttattattgaatcagtcccagacgattgttatatggaacttgtggactactggcgtaacggcgggatcggcattctgtctgacaaggccgtacagtataaagacaaggtctcacactatgaggccacgatggacattgttaaagaccgccgttacacggtcgataagttctttatccatcttcccatcactatcaactttaaagctgatggccgtatcaatattaatgaaaaggttctgaagtatatcgccgagaacgacgagttgcatgtgattggaattgatcgcggtgagcgcaaccttctgtatgtttcggtgattaataaaaagggtaagatcgtcgagcagaaaagttttaacatgattgagtcttatgagacagtcactaacattgtccgtcgctataattataaagataaactggttaacaaagagtcagctcgcacggacgctcgtaagaattggaaggaaatcgggaagattaaagagattaaagaggggtatttatcgcaggtcattcacgaaatttccaagatggtgcttaagtataacgcgattattgtgatggaggatttgaactatgggttcaaacgcggacgctttcgcgtcgaacgccaggtctaccagaagttcgagaatatgcttatcagcaagctggcgtatcttgtggacaagtctcgcaaggcagacgagcccggcggcgtcttacgtggctaccaattgacgtacatcccggacagtttggagaaattgggatcccagtgcggtattatcttttacgtaccagcggcatacacatcaaagattgatccccttaccggcttcgtgaacgtgttcaactttcgtgaatatagcaacttcgagaccaaactggatttcgtgcgctccttagatagcattcgctacgataccgaaaagaaacttttcagcattagcttcgattatgataacttcaaaactcacaacactaccttagcaaaaaccaaatgggtaatctatttgcgtggcgaacgcatcaaaaaggaacatacctcctatggctggaaggacgacgtctggaacgttgagtcgcgcatcaaggacttattcgactcgagtcacatgaagtatgacgatggacataatcttattgaagatattttggagttagaatcgagcgtgcaaaaaaagcttattaacgaacttattgaaattatccgcctgacagtacagctgcgcaacagtaagtcagagcgttatgaccgcactgaagcagagtatgatcgcattgtatcgccagtaatggatgagaatggccgtttctatgactccgaaaactacatttttaacgaggaaaccgaattgcccaaagatgctgatgcaaatggagcatattgcatcgcattgaaagggctttacaacgtgatcgccatcaaaaacaattggaaagaaggcgagaaattcaaccgcaaattacttagtcttaacaactataattggtttgattttattcagaaccgtcgtttctaa

SEQ ID NO: 910 - DNA, 3867 bp, Coprococcus sp.
  source 1..3867: mol_type = genomic DNA
atggtaggtaataaaatatcaaattcgtttgattcgtttactggaatcaacgcattaagtaaaacgttaagaaatgagttaattccatcagattatactaagagacatattgctgagagtgattttattgcggctgatacaaacaaaaatgaagatcagtatgtagcaaaagaaatgatggatgattattatcgcgattttataagtaaggttctagataatttacatgatatagaatggaaaaatttgtttgaattaatgcataaagcgaaaatagataaaagtgatgcaacttcaaaagagttgataaaaattcaggatatgcttcgtaaaaaaataggaaaaaaattctctcaagatcctgaatataaagtcatgctcagtgctggtatgataacaaagattttaccaaaatatatattggagaaatatgaaactgatagagaagacagattagaagcaataaaaagattttacggattcacagtttattttaaagaattttgggcaagtagacaaaatgtattttctgataaggcaatagcgtcatctatatcatatagaatcatacacgagaatgccaaaatatatatggataacctggatgcttataatagaataaaacagattgcttgtgaagaaattgagaagattgaagaagaggcatatgtttttctgcaaggtgaccagttagatgtggtatataccgaagaagcatatggacgatttatatcccagagtggaatagatttatataataatatatgtggggttattaatgctcatatgaatttatattgccagagcaaaaaatgctccagatcaaagtttaaaatgcaaaaattacataaacagattttatgtaaagcagaaaccgggtttgaaattccattaggctttcaagatgatgcgcaagtgataaatgcgattaattcatttaatgctctaataaaagaaaaaaatattatatcacgtctcagaactatagggaaaagcatatctttatatgacgtaaataagatatatatttcatctaaagcgttcgagaatgtatctgtatacattgatcataaatgggatgtgatagcttcaagcttgtataagtatttctcggaaattgtcaaaggaaataaagacaacagggaagaaaagattcagaaggaaattaagaaagtaaagagctgtagtctgggtgatttgcagagactggttaattcatattataaaatagatagcacatgtttggagcatgaagtaactgaatttgttactaaaataatagatgggatagataactttcaaattacggattttaaatttaacgacaaaattagcttgattcaaaatgaacagattgtcatggatataaaaacatatcttgataaatatatgagtatttatcattggatgaaatcgtttgtgattgatgagctagttgataaggatatggagttttattcagaacttgatgaacttaatgaggatatgtcggaaattgtgaatttatataacaaagtgcgtaactatgttacacagaagccttatagtcaggaaaagataaaattgaacttcggatcaccgactcttgccgatggatggtcgaaatcaaaggaatttgataacaatgctattatattgattcgtgatgaaaaaatatatttggcaatatttaacccaagaaataaaccagctaagactgttatatcaggacacgatgtttgcaattctgaaacagattataagaaaatgaattattatttgctccctggggcaagtaagactttaccacatgtgtttattaagtctagattgtggaatgaatcacatggaatacctgatgaaatactgcggggatatgagttgggtaaacacttgaaatcatcggtaaattttgatgtagaattctgctggaagctaattgattattataaagaatgtataagctgttatccaaattataaggcgtataattttaaatttgctgatacagaatcgtacaatgatatatcagaattctatagagaagtggagtgtcagggatataagattgactggacatatataagttcagaagatgtagaacaacttgatcgtgatggtcaaatatatctgtttcaaatctataataaagactttgcaccgaatagtaaaggaatggataatcttcatacgaagtacctcaaaaatatatttagcgaagacaatcttaaaaacatagttataaaattgaacggagaggcagaattattttatagaaaatcaagtgtcaagaaaaaagtagaacataaaaagggtacgattttagtcaataaaacatataaggttgaggataacactgaaaacagtaaagaaaaaagagttattattgaatcagtaccagatgattgctatatggaacttgttgattattggagaaatggtggtatcggaattctttcagacaaagctgttcaatataaggacaaagtatctcattatgaagctactatggatatagtcaaggatcgcaggtatacagtagataagttttttatacatttgcctataactatcaatttcaaagcagatggaagaattaatataaatgaaaaggtactcaagtatatagcggaaaatgatgagcttcatgtgattggaattgatagaggagaaagaaatctcctttatgtgtcagtaattaataaaaagggaaagattgttgagcagaagtctttcaatatgatagaaagctatgaaactgtaacaaatatagttagaagatataattataaagacaaactggtcaacaaagaaagtgcccggacagatgcgagaaaaaattggaaagaaattggaaagataaaagaaataaaagagggatacttgtcacaggtaattcatgaaatatcgaagatggtgttgaaatataatgcaatcattgttatggaagatctaaattatggatttaaacgaggtaggtttagggttgaacgtcaggtataccagaaatttgagaatatgttgatatctaaactggcatacttggtagataaaagtcgaaaagccgatgaaccaggaggtgtactaagagggtatcagcttacgtatattccagattctttagagaaacttggtagccagtgtgggatcatattctatgtacctgctgcgtatacatctaagattgatccgttaacaggctttgtaaatgtattcaattttagagaatattctaattttgaaacaaaattggattttgttagatcattagacagtatacgatatgatacagagaagagattgttttcaatatcatttgattatgacaactttaaaacacataataccactctggcaaaaacgaagtgggttatatatttacgaggcgagcgtataaaaaaggaacatacatcttacgggtggaaggatgatgtttggaatgtggaaagtagaattaaagacttgtttgacagttcacatatgaaatacgatgatggacataatttaattgaagatattcttgaattagaatcgagtgtacagaagaagctgatcaatgaattgatagaaataataaggttgactgttcaacttcgtaacagtaagtcagagagatacgataggacagaagctgaatacgacagaatagtatcgccagttatggatgaaaaaggacggttttatgattcggaaaattatattttcaatgaagaaacagagttaccaaaggatgcagatgctaatggtgcatattgcattgcattaaaaggtctgtacaatgtcatagccataaagaataactggaaagaaggagagaaattcaacagaaaattgttaagtctaaataattataactggttcgattttatacaaaatagaaggttttaa

SEQ ID NO: 911 - DNA, 3867 bp, synthetic construct
  misc_feature 1..3867: note = Description of Artificial Sequence: Synthetic polynucleotide
  source 1..3867: mol_type = other DNA
atggttggaaacaagatttcaaatagctttgacagcttcaccggaattaatgccttgtctaagacattacgtaacgaattgatcccgagtgactacaccaaacgccatattgcggagagtgacttcattgctgcggatacgaataagaatgaggaccaatatgtcgccaaggagatgatggacgattactaccgtgacttcatttccaaagtgttggacaacctgcatgacatcgagtggaagaatctgtttgagcttatgcacaaggctaaaattgataagagcgatgctactagcaaagagcttatcaagatccaggatatgctgcgcaagaaaattggcaaaaagttttcacaggacccagagtacaaagtaatgttatccgcgggcatgattacgaaaattcttcccaagtatattttggagaagtacgaaacagaccgcgaagatcgtttggaggcgattaagcgtttctacggcttcaccgtttattttaaagaattttgggcctctcgtcaaaatgtgttttcggataaggcgatcgcctcatctattagctaccgcatcatccacgaaaatgccaaaatctatatggataatcttgacgcctataatcgtatcaagcaaattgcatgtgaggagattgagaagatcgaggaagaggcatatgtgtttttgcagggtgaccaattggacgttgtgtataccgaggaagcctacggtcgctttatttcccagtcgggtattgacttgtacaacaatatttgcggagtgatcaatgctcatatgaacctttattgccaatcgaaaaagtgctcgcgcagcaagtttaagatgcagaaattgcataaacaaatcttgtgtaaagcggaaacagggtttgagattcccttaggattccaggacgatgcgcaagttatcaatgccattaattccttcaatgcactgattaaagaaaaaaatattattagccgtcttcgtactattgggaagtccattagtctttacgatgtgaacaagatttacatttcttcgaaggcgtttgagaatgtgtccgtgtatattgatcataaatgggacgtcatcgctagttctctgtacaaatacttcagtgaaatcgttaaaggcaataaggacaaccgtgaagagaagatccaaaaggagattaagaaagttaagtcgtgcagccttggggacctgcaacgtttggtgaacagctattacaaaattgattcaacgtgcctggaacatgaagtaaccgaattcgtaacaaaaattattgacggtatcgataatttccaaattacagacttcaagttcaacgataaaattagtcttattcaaaacgaacagatcgtgatggacatcaagacttacttggacaagtatatgtccatttaccactggatgaaatcgttcgttatcgatgagcttgttgataaagacatggaattctactccgaacttgatgaattaaacgaggacatgagtgagattgttaacttatacaataaggtccgtaattacgttacgcagaaaccgtatagccaggaaaagattaaattaaattttggcagcccgacattggctgacggatggagcaaatctaaggagtttgataataacgcgatcatccttatccgcgatgagaagatttatctggctattttcaatccacgtaataagccggcgaagacagtcattagcggacatgatgtctgcaactcggaaacagattataaaaagatgaactattatttattaccgggggctagcaagactttaccccatgtgttcattaaatctcgcttgtggaacgagagccacggaatccccgatgagatccttcgcggctatgaattaggcaaacatcttaaaagtagcgtaaactttgatgtggaattctgctggaagcttatcgactattacaaagaatgtatctcatgttacccaaattataaggcatataattttaagttcgctgacaccgagtcatacaatgatatcagtgaattttatcgcgaagtggaatgtcaagggtataaaattgattggacctatatttcaagtgaggacgtggagcaactggatcgcgacggtcagatctacttatttcagatctacaacaaggactttgcgcccaatagtaaggggatggataatttgcacaccaagtacctgaaaaacattttttcggaggacaatttgaaaaatattgtcattaaacttaatggagaggccgaactgttttaccgcaaatctagtgttaaaaagaaggttgagcataaaaaaggtactattttagtgaataaaacatacaaagtagaagacaatacggaaaacagcaaagagaagcgtgtaatcattgaaagtgtaccggacgactgctacatggaacttgtggattattggcgcaatggtggcatcggtatcttatcggataaagctgtgcagtataaggacaaggtttcccattatgaggcgactatggatatcgttaaagatcgccgttacactgtagacaagttcttcatccatttgccgattactattaactttaaggcggacgggcgcatcaacattaacgaaaaagtacttaagtacatcgctgagaacgacgagcttcacgtcattggtattgaccgtggagaacgcaatttattatatgtatcagtaattaataagaaaggaaagatcgtcgaacaaaaaagtttcaatatgatcgagtcatacgaaacagtcacgaacattgtgcgtcgctacaattataaggataaacttgtgaataaggaaagcgcacgtacagacgcccgcaaaaactggaaggaaatcgggaaaattaaagaaatcaaggaaggatacctgtctcaagttattcacgaaatttccaaaatggtacttaaatacaatgctattatcgtcatggaggatttgaattatggctttaagcgcggacgctttcgtgttgaacgccaagtataccagaagttcgaaaatatgttaatctctaaattggcatacctggtggataagagccgcaaggccgacgaaccaggaggggttctgcgtggataccaattaacatatattccggatagtctggagaaacttggatctcagtgcggtatcattttttatgttccggcagcttatacctcaaagatcgatccgctgacaggatttgtcaacgtatttaattttcgcgaatattctaatttcgagactaaattagactttgtccgttcgttagattctatccgttacgatactgaaaagcgtctgttctctatttctttcgactacgacaactttaaaacgcataatacgacgcttgccaagaccaaatgggttatctatttacgtggagagcgcatcaaaaaagagcacacatcttacggatggaaggacgatgtatggaacgtcgagtcgcgcatcaaggacttgttcgactcaagtcacatgaagtacgacgacggacataacttgattgaggacatccttgagctggagtccagtgtacaaaagaaattaatcaatgagctgatcgagatcattcgcttaacagttcagttgcgcaactccaaaagcgagcgttatgaccgcaccgaagccgagtacgaccgtattgtatcacccgtgatggacgagaagggccgcttctacgacagcgaaaattacatttttaacgaggaaactgagcttcccaaggatgccgacgccaacggtgcttactgtatcgccttaaaggggttatacaacgtcattgcgattaaaaataactggaaggagggtgagaagtttaaccgtaagttattatcgcttaacaactataattggtttgattttattcagaaccgtcgcttttaa

SEQ ID NO: 912 - DNA, 3867 bp, synthetic construct
  misc_feature 1..3867: note = Description of Artificial Sequence: Synthetic polynucleotide
  source 1..3867: mol_type = other DNA
atggtgggtaataaaatttccaactctttcgacagtttcaccggaatcaacgctttgtccaagacattgcgcaatgaattaatcccttcagattacacaaagcgccacattgccgaaagcgacttcatcgctgccgatacaaataaaaacgaagatcagtatgtagcgaaagaaatgatggatgattactatcgtgacttcatcagcaaggttctggataatctgcatgatatcgagtggaaaaatttatttgaacttatgcacaaagctaagatcgataaatccgatgcaacgtcgaaggagctgatcaagatccaggacatgctgcgcaagaagattgggaaaaagttctcacaagacccggaatacaaagtaatgttgtcagcaggaatgatcactaaaattctgcccaagtacattttagaaaaatacgaaaccgaccgcgaagatcgtttagaggcaatcaagcgcttctacggctttaccgtatatttcaaagagttctgggctagtcgccaaaatgttttctctgataaggctatcgcctcatcgatttcatatcgcatcatccacgaaaatgcaaagatttatatggacaacctggacgcttataatcgcatcaagcagatcgcttgcgaggagattgaaaagatcgaagaagaggcatatgtatttttacaaggggaccagttagatgtggtctacacagaagaagcatatggacgcttcatctcccaatcagggattgacctgtacaacaatatttgcggtgtgattaacgcacatatgaatttgtattgccagtccaagaagtgttcccgcagtaaattcaagatgcagaaattgcataagcagatcttatgcaaagccgagacgggttttgaaatccccctgggcttccaagatgacgcacaggtcatcaacgccatcaattcatttaatgcccttatcaaggagaagaatatcatctctcgtttacgcactatcgggaaaagtatctcactttacgacgtcaacaagatctatatttcgagtaaagcgttcgaaaatgtgtcagtgtatatcgaccataaatgggatgtgattgcctcatcactgtacaagtacttcagcgagattgttaaaggaaataaggataatcgcgaggagaagatccagaaagagatcaagaaagtcaagtcatgcagtcttggagacttacaacgccttgttaattcgtattacaagatcgattccacctgtcttgagcacgaagtcacggagttcgtaacaaaaatcatcgacggcatcgacaatttccaaattacagactttaaattcaatgacaagatcagtttaattcagaatgagcagatcgtgatggacatcaaaacatatctggataagtacatgtcaatttatcattggatgaagtcatttgtaatcgatgagctggttgataaagacatggaattctattctgagttagacgaacttaacgaagatatgtccgagattgttaacttatataacaaggtccgtaactacgtcacacagaagccctattcacaggaaaaaattaagttgaatttcggatccccgactttggctgatggctggtccaagtctaaagagttcgacaacaacgcgatcatcctgattcgcgatgagaagatctatctggcaatctttaacccccgcaacaagcccgcaaaaacagtcatctccggccatgacgtctgtaattcggagacggattacaagaagatgaattattatttgttgccgggtgcctccaagacgttgccacacgtttttattaaaagtcgcctgtggaatgagtctcatggtattccggatgaaattttacgtggctatgaactgggcaaacatcttaaatcttcggtaaacttcgatgtggaattttgctggaaacttattgattactataaggaatgcatctcttgctatccgaactacaaagcttataacttcaaattcgcggacacagagtcttacaacgatatttcagagttttatcgcgaggtggagtgtcagggttacaagattgactggacgtatatctcgtctgaggacgtagaacagttggatcgtgacggacagatttacttgtttcaaatttacaacaaggactttgctcccaacagcaaagggatggacaacctgcacacgaagtatttaaaaaatatctttagcgaggacaatctgaaaaatatcgttattaagttaaatggcgaggctgagctgttttatcgcaaatcgtcggttaagaaaaaagtagaacacaaaaaaggtactatcttagtgaataagacatataaagttgaggacaacaccgaaaactcaaaagaaaagcgcgtaatcattgagagtgtgccagacgattgctacatggaattggtagactactggcgtaacggaggcatcggaatcctgagcgataaggctgtacaatacaaagacaaagtgtcacattacgaagcaacaatggatatcgttaaggatcgtcgctatacagttgataagttctttattcatctgcctattaccattaattttaaggctgacggtcgtatcaatatcaacgaaaaggtccttaagtatatcgctgagaatgacgaacttcacgttatcggtatcgatcgtggagagcgtaacttattatacgtgtcagtaattaataagaaaggaaagatcgtggagcaaaaatcgttcaatatgattgagtcctatgagaccgtaactaatattgttcgccgttacaactacaaggataagttagtaaataaagaatctgctcgcacggacgcccgcaaaaattggaaagagatcggaaagatcaaggaaatcaaagaaggttatttaagccaggtcatccacgaaatttcaaagatggtccttaagtataacgccattatcgttatggaggaccttaactacgggttcaagcgcggccgctttcgtgtagaacgtcaagtttatcaaaagttcgagaacatgcttatcagcaaactggcgtatctggttgacaaaagccgtaaagcggatgagcctggtggtgttcttcgtggttatcaattgacttacattcccgattccctggaaaaacttggtagccagtgtggtattattttctacgttcctgcggcctacacgtcaaagatcgacccccttacaggttttgtcaacgtttttaactttcgcgagtattcaaactttgaaacaaagttagactttgtacgcagcttagatagcattcgttatgatacggaaaaacgtttgttcagcatcagctttgactatgacaattttaagactcataacacaacattagcgaaaacaaaatgggttatttatcttcgtggcgaacgtatcaaaaaggagcatactagctatgggtggaaggatgacgtgtggaatgtggaatcgcgcatcaaagacttgttcgatagttctcacatgaagtatgacgacggtcacaatcttatcgaagacattctggagctggagtctagcgtccaaaagaaacttatcaatgagttgattgagatcattcgcttaactgtacagcttcgtaattctaaatcggagcgctacgaccgtacagaagctgagtacgaccgcatcgtcagtccagtgatggatgaaaaggggcgcttttacgactccgagaattacatttttaatgaagagactgaacttccaaaggacgcggatgcaaacggggcttattgtattgcactgaagggattatacaacgttattgccatcaagaataattggaaggagggcgagaagtttaaccgcaaattgttgtctttgaataattacaattggttcgattttattcaaaatcgccgtttctaa

SEQ ID NO: 913 - DNA, 3867 bp, synthetic construct
  misc_feature 1..3867: note = Description of Artificial Sequence: Synthetic polynucleotide
  source 1..3867: mol_type = other DNA
atggtaggcaataaaatctcgaattcattcgattcctttactgggatcaacgcgttatcgaaaacattgcgcaatgaacttatcccgtcagattacaccaaacgtcatatcgcagagtcggattttatcgccgctgacacaaataaaaacgaggaccagtatgtggctaaagagatgatggacgactactatcgtgatttcatctccaaggtattagataaccttcatgacattgagtggaaaaacttgtttgagctgatgcacaaagcaaagattgacaaatcggacgcaacttcaaaggagcttatcaaaattcaggacatgttgcgcaagaagatcggaaaaaagttcagtcaggacccagaatacaaagtgatgttgtcggctgggatgattacaaaaattttaccgaagtacatcttggaaaaatatgagacagatcgcgaagatcgccttgaagcaattaagcgcttctatggattcacggtttactttaaggagttctgggcttctcgccaaaatgtgttttcggataaagcgattgccagcagtatcagttaccgcatcatccacgaaaacgccaaaatttatatggacaacctggatgcttataaccgtattaagcagattgcctgcgaagaaattgaaaaaatcgaggaggaggcatacgtattcttacaaggtgatcaacttgacgttgtgtatacagaagaggcgtacggtcgtttcatctcgcaaagcggcattgacctgtacaataacatctgcggtgtgattaacgctcacatgaatctgtactgtcagagcaaaaagtgctcacgttcaaagttcaaaatgcaaaaattgcataaacaaattttatgcaaggcagagacggggtttgaaatccctctgggattccaggacgatgcacaggtaattaatgcaatcaactcgtttaacgctctgattaaagagaagaacattatctcacgtttacgcacgatcgggaaatctatctccttgtatgacgtcaacaaaatttatatctcttcaaaagctttcgaaaatgtgtcggtctacattgaccataagtgggacgttatcgcgagttcattgtacaaatatttcagtgagatcgttaagggaaacaaggacaatcgcgaggaaaagatccagaaagagattaagaaggtaaagagttgtagtttaggcgatttgcaacgtctggtcaactcatattataagatcgatagtacatgcttagaacatgaagtaacggagttcgtgactaagatcatcgatggaattgataactttcagattacagacttcaaattcaatgacaaaatctcgttaatccaaaacgaacagattgttatggacatcaaaacgtatttagacaaatacatgtcaatttatcattggatgaagtctttcgtgatcgacgagttagttgataaggatatggaattctattctgagttagatgaattaaatgaagacatgagcgaaattgtgaacttatataataaggtccgcaactatgtgacacagaagccctactcacaggaaaagattaaattgaacttcgggtcgccgacattagccgacggttggtcaaaatcaaaggaattcgataacaatgccattattttaattcgtgatgagaaaatctacctggcaatttttaatccccgcaacaaacccgcaaaaactgtaatcagtggccacgatgtatgcaactccgaaacagattacaagaaaatgaattattatttactgccaggggcgagcaaaacccttccacacgtatttatcaaatcccgcttatggaacgagagtcatgggattccagatgaaatcctgcgtggctatgagctggggaagcacctgaagtcctctgttaactttgatgtcgagttttgttggaaactgattgactactataaggagtgcatctcctgctacccaaactataaggcttacaattttaaattcgccgacacggagagttacaacgatatttccgagttctatcgcgaagtggagtgtcagggatacaaaattgattggacttatatctcctcagaggatgtagaacaattggaccgcgatggccagatctacttatttcaaatttacaataaggattttgccccaaactcgaaggggatggacaatctgcacacaaaatacctgaagaatattttctcggaggacaacttaaaaaacattgtaattaaattaaacggtgaggcagaactgttttatcgtaaatcaagtgttaagaagaaagttgagcacaaaaaagggacaattttagttaataagacgtataaagtcgaagacaacacggaaaactccaaggaaaaacgtgtaattattgagtcggtccccgatgattgttacatggaattggttgattactggcgtaatggcgggatcggcatcttgtcagacaaagctgtccaatacaaggacaaagtgtctcattatgaagccacgatggacatcgtaaaggaccgtcgctatactgtcgacaagttttttattcacctgccgatcacgattaattttaaagcagatggccgtatcaacattaatgagaaagtcctgaagtacatcgcagagaacgatgaactgcacgtcattggaatcgatcgcggagagcgtaatttattatatgtttctgttatcaacaaaaagggcaaaatcgtggagcagaaatcgttcaatatgattgaatcttacgagacggtaacaaacattgtacgccgttacaattataaggacaaattggtaaataaagagagcgcacgtaccgacgctcgcaaaaattggaaagaaattggtaagatcaaggaaattaaggaaggctacctgtcgcaagtaatccatgaaatctcgaaaatggtattaaagtacaacgcgattatcgttatggaggacctgaactatggtttcaagcgcggacgctttcgtgttgagcgtcaggtctaccaaaagttcgagaacatgttaatttctaaattagcatacttggttgacaagtcccgtaaagcggatgagcccggtggagtacttcgcgggtatcaattaacctacatcccagacagtttagagaaactgggcagccagtgtggtattatcttttacgttcctgccgcgtacacctctaagatcgacccccttaccggttttgtcaatgtcttcaactttcgcgagtattcaaatttcgaaaccaaattagatttcgttcgcagcttggacagcattcgttacgataccgaaaaacgccttttctctatctctttcgattacgataattttaagacacacaatactactctggccaaaacaaagtgggtgatctacttacgcggagagcgcatcaaaaaggagcatacgagttacggatggaaggatgatgtgtggaacgtagaatcgcgtattaaggatttattcgacagttcccatatgaagtatgatgatggacacaacttgattgaagatattcttgaactggagtctagcgtacagaaaaagctgatcaacgaacttattgagattatccgtttgaccgtccaacttcgcaactcgaagtcggaacgctacgaccgtactgaagccgaatatgaccgtattgtgtcccctgtcatggacgagaaggggcgcttttacgactctgagaattatatcttcaatgaagagacagagttgccaaaagatgcagatgccaatggggcttactgtattgcactgaaggggttgtataatgtcatcgctatcaagaataattggaaagagggggaaaagttcaaccgtaaacttcttagtcttaacaattacaactggtttgacttcattcaaaaccgtcgcttttaa

SEQ ID NO: 914 - DNA, 3738 bp, Ruminococcus sp.
  source 1..3738: mol_type = genomic DNA
atgcaagagcataaaaaaatatcgcatcttacacacagaaattcagttcaaaaaacaattaggatgcaactgaatcctgtaggtaaaacaatggattattttcaagcaaagcaaattcttgagaatgatgaaaagcttaaagaggactatcagaaaatcaaggaaatagcagacaggttttacagaaatttaaatgaggatgtactttcaaaaaccgggttagataaattaaaagattatgctgaaatttactatcactgtaatacggatgcagaccgaaaaagacttgatgaatgtgcatcggaattaaggaaagaaatcgtcaaaaattttaagaatagagatgagtataacaaactattcaataaaaagatgattgagatagttcttccccagcatcttaaaaatgaggacgaaaaggaagttgtagcctcatttaaaaatttcacaacatactttacaggtttcttcactaacagaaaaaatatgtattcggacggagaagaatccacggcaatcgcatatagatgcattaacgaaaatttgcctaagcatcttgacaatgtcaaggcctttgaaaaagcaatttctaagctatccaaaaacgcagttgatgatttagataccacttattccggcttatgcggtacaaatttgtatgatgtttttacagttgattattttaactttttgcttccacaatccggaattaccgaatataataaaatcatcggcggttacacaacaagcgacggtacaaaagttaagggtattaacgaatatataaatttgtacaatcaacaagtatccaaacggtataaaattcctaatcttaaaattttgtataaacaaattttaagtgagagtgaaaaggtatcattcataccgccaaagtttgaagatgacaacgaacttttatcggctgtttcagagttttacgcaaacgacgaaacctttgacgggatgccattaaaaaaagcaattgatgaaacaaagctattattcggcaatttagataattcctctcttaatggaatttacattcaaaatgaccgatccgtgacaaatctgtcaaacagtatgttcggttcttggtcagtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttccaattccgaaaatgatgaaatcagagaaaagtctatcgtagattactacaagacttctttaatgcaacttaccgacaatttatcagacaaatacaaagaagcagcacctctgttcaacgaaagttacgctaatgaaaaaggtttgaaaaatgacgataaatctatttcattaattaaaaattttcttgatgccataaaagaaattgaaaaattcatcaagcctttgtccgaaactaatattacaggtgagaaaaatgatttgttttacagtcagttcacaccattacttgataatatcagcagaatagacatattatatgataaggtcagaaactatgttacacaaaaaccgttttcaaccgataaaatcaaacttaactttggcaattcacagctattaaacggctgggatcgaaacaaagaaaaagactgcggtgccgtttggctttgtaaagatgaaaagtattatcttgcaatcatagataaaagtaataatagtattttggaaaatattgattttcaagactgcgatgaaagcgattgttatgaaaagataatttacaagcttctccccggtccaaataaaatgcttccaaaagttttcttttcagaaaagtgcaagaaacttttgtcaccgtcagacgaaatacttaaaattcgtaaaaacggcactttcaaaaaaggtgataagttcagccttgatgattgccataagttaattgatttctacaaagaatcattcaaaaagtacccaaattggttaatttataactttaaattcaaaaaaacaaacgaatataatgatatcagcgaattttataatgatgttgcttcacagggatataatatttcaaaaatgaaaatcccgacatcatttattgacaaacttgtagatgaaggaaaaatctatcttttccaactctacaacaaagacttttcaccgcatagcaagggtactcctaatctgcatacactttattttaaaatgttgtttgatgaaagaaatcttgaagatgtggtgtacaagcttaacggtgaggcagaaatgttttatcgtcctgcaagtataaaatatgacaaaccaactcatcccaaaaacacaccgataaaaaataaaaatacactcaatgataaaagagcaagcacttttccttatgacttaatcaaagataaacgctacactaagtggcagttttcacttcacttccctattaccatgaattttaaagctccggatagggcaatgatcaatgatgatgtcagaaatctgctgaaatcctgcaacaacaatttcatcataggaattgacagaggcgaaagaaacttgctttatgtcagcataattgacagcaacggtgctataatatatcagcactcactcaatattatcggaaacaagtttaaaggaaaaacatacgaaactaactaccgggaaaaacttgaaacaagagaaaaagagcgtacggaacagcgccgtaactggaaagcaattgagagtataaaagaactcaaagagggctatatcagtcaggctgtgcatgttatatgtcagcttgttgtcaagtacgatgcaatcatcgttatggaaaagctgactgacggattcaaacgaggcagaacaaagtttgaaaaacaggtttatcagaaatttgaaaaaatgctgattgacaaacttaattactatgttgacaaaaagcttgatcccgatgaagaaggcggtttacttcatgcctaccagcttacgaacaagcttgagagctttgataagcttggcatgcaaagcggttttattttctatgttcgtcctgattttacaagcaaaattgatcccgttaccggctttgtaaatttgttgtatcctcgatacgaaaacattgacaaagccaaagatatgatttcaagatttgacgatataagatacaatgccggcgaggacttttttgaatttgacattgattacgataagtttccaaagactgcgtctgactatcgcaagaagtggacaatctgtactaacggcgaaaggattgaagctttcagaaatcccgcaagcaataacgaatggagttatcgtacaataattcttgcagaaaaatttaaagaattatttgataacaattctataaattatcgtgattctgacaatttgaaagctgaaattctttcacagacaaagggcaaattttttgaggatttcttcaaattattaagacttaccctacagatgcgaaacagtaaccctgaaacaggcgaggaccgtattctttctcccgtcaaggacaaaaacggtaatttttacgacagttcaaaatatgacgaaaagagcaatcttccgtgtgatgccgatgcaaacggtgcgtacaacattgcccgcaaaggtttgtggattgttgaacaattcaaaaaatccgataatgtttcaactgtcgaaccggtaatccacaatgacaaatggctgaaatttgttcaggagaatgatatggcgaataattaa

SEQ ID NO: 915 - DNA, 3738 bp, synthetic construct
  misc_feature 1..3738: note = Description of Artificial Sequence: Synthetic polynucleotide
  source 1..3738: mol_type = other DNA
atgcaggaacacaaaaagatcagtcacttgacccatcgcaactcggtgcagaagacgatccgcatgcaattgaacccagtcggtaagacgatggactactttcaggctaaacagattcttgagaacgacgagaaattaaaggaagattaccaaaaaatcaaggagattgcagaccgcttctatcgcaatttaaacgaggatgtactgtcgaagactgggttggacaaacttaaggattatgctgaaatttattatcactgcaatactgatgccgaccgcaaacgtctggatgaatgcgcttccgagctgcgtaaggaaattgtaaaaaattttaagaaccgcgacgagtataataagctttttaataaaaaaatgattgaaatcgtattgccccagcacttaaaaaacgaagacgaaaaagaagtggtcgcttctttcaaaaatttcacaacctatttcacgggtttttttacaaatcgcaagaatatgtattctgacggggaagaatcgacggcaattgcttaccgctgcattaacgagaacttgcccaaacacttagacaacgtaaaggcttttgagaaagcgattagcaaactgtccaagaacgcagttgatgatctggacacaacctatagcgggttatgtggcacaaatctttatgatgtttttacggttgactactttaattttttacttccgcagtccggtattacggagtataacaagatcatcggagggtacacgactagcgatggcaccaaggtaaaagggattaacgagtacattaacctttacaaccaacaggttagtaaacgttataagattccgaatctgaagattctgtataagcaaatcctgagtgaatcagagaaagtatcgtttatcccgccaaagtttgaagatgataacgagcttctttccgccgtctccgagttctatgcaaacgatgagacttttgacgggatgccgcttaaaaaagccattgatgagacgaagcttttgtttgggaacttggacaattcgtcgcttaatggcatttatatccaaaacgaccgtagtgtcacgaacctgtcgaattcaatgttcgggtcttggtctgtaatcgaagatctttggaacaagaactatgactcagtaaatagcaatagtcgcattaaagatattcagaagcgtgaagacaaacgcaagaaagcgtataaagccgaaaaaaaattatctcttagctttcttcaagtcttaatctcaaatagcgagaatgatgagatccgtgagaagtctattgtagattactataagacgagtttaatgcaattaactgataacctgtcggataaatataaggaagctgcgccattatttaatgagtcctacgcaaatgagaagggcttgaaaaatgacgataagtcaatctcattgattaaaaattttttagatgccatcaaagaaattgaaaaattcattaaaccattaagtgagactaatatcacgggtgagaagaacgacttgttctactctcaatttacgcctttattggacaacattagtcgtattgatattctgtacgacaaagtgcgcaactacgtcacccagaagcctttcagcacagacaagattaagttaaatttcggcaactctcaattgttgaacggttgggatcgtaataaggagaaagattgtggtgctgtctggctttgcaaagatgaaaaatactaccttgcaatcattgacaagtctaacaactctattctggagaacatcgattttcaggattgcgatgaatcagattgctacgaaaaaatcatctataagttattacctggaccgaacaaaatgttgcctaaagttttcttttcggagaagtgtaagaagcttctttccccatcggatgaaatcttgaagatccgcaaaaatgggactttcaaaaaaggggataaattctctctggacgactgtcacaaattaatcgacttctacaaggaatcttttaagaagtatcctaattggcttatttataatttcaaattcaagaagacgaatgaatataacgatatctcagaattttataatgacgtcgcttcgcaggggtacaatattagcaaaatgaaaattcccacgtcgttcattgacaaacttgttgatgaaggtaaaatttacttatttcagttgtacaacaaggattttagtccgcacagcaagggcacgccaaatctgcatactctgtatttcaagatgttgtttgatgaacgtaatttggaggacgtggtgtataagcttaacggggaagcggaaatgttctatcgccccgcatcaattaagtatgataagccgacacacccaaaaaacacccccattaaaaacaaaaacacgttaaacgataaacgtgcttcgacattcccctacgacttgattaaagacaagcgctatactaaatggcaatttagccttcactttccaatcactatgaacttcaaagctcccgatcgcgccatgattaacgacgacgttcgcaatttacttaaaagctgcaataacaactttatcattgggattgaccgcggcgaacgtaatctgttatatgtctcaatcatcgattctaatggcgcaatcatttatcaacacagcttgaatatcattgggaataagtttaagggtaaaacctatgaaacaaactatcgcgagaaacttgaaacgcgcgagaaagaacgcacggagcaacgccgcaactggaaagccatcgagtccatcaaagaattaaaggagggatacatctcgcaagctgtacatgtgatttgccagcttgttgtgaagtacgacgcaattatcgtgatggagaaattgacagatggattcaagcgcggtcgtactaagtttgaaaagcaagtgtaccaaaaattcgaaaagatgcttatcgataaacttaattactacgtagataaaaaactggaccccgatgaggaaggggggttgctgcacgcatatcaactgacaaacaaattggagtctttcgataagttaggtatgcaatcgggcttcatcttttatgtacgcccggacttcactagcaaaattgaccctgtaaccggcttcgtaaaccttctttatcctcgctacgaaaatattgataaagcaaaggatatgattagccgtttcgacgacattcgctacaatgcgggtgaagacttttttgaatttgacattgattacgacaaatttcccaagacggcctccgattaccgcaaaaaatggactatctgcactaacggagaacgtattgaagcatttcgcaacccggcctccaacaatgagtggagctaccgtaccatcatccttgccgaaaagttcaaagaattatttgataataattcgatcaactatcgcgattcggataacttgaaagctgaaatcctttctcagaccaaaggaaagttttttgaagactttttcaaattgttgcgtctgacattacagatgcgcaatagtaatcccgaaacgggcgaagaccgcattttaagtccggttaaggataaaaacggcaatttctacgatagctctaagtatgacgagaaatcgaatttaccatgtgacgcagatgcaaacggtgcgtataacatcgcgcgtaaaggtttgtggattgtcgagcagtttaaaaagtctgacaacgtttctacggtagaaccggttatccataatgataagtggttaaaatttgtacaggagaacgacatggccaacaactaa

SEQ ID NO: 916 - DNA, 3738 bp, synthetic construct
  misc_feature 1..3738: note = Description of Artificial Sequence: Synthetic polynucleotide
  source 1..3738: mol_type = other DNA
atgcaggaacataaaaagattagtcacctgacccaccgtaattctgtacaaaagaccattcgcatgcagttaaatccggtaggcaagacaatggactactttcaggcgaaacagattttagagaacgacgagaaattaaaagaagactatcagaagatcaaggaaattgctgatcgtttttaccgtaatcttaatgaagatgtcttgagtaagacgggtcttgacaaattgaaggactatgctgagatttattatcattgcaatactgatgccgatcgtaaacgtttggatgagtgtgcgtcggagttgcgcaaggagattgtcaagaattttaaaaaccgcgatgaatacaacaagttgttcaacaagaaaatgatcgagattgtgctgccgcaacaccttaaaaacgaagacgagaaggaggtcgtagcatcctttaagaactttactacatactttaccggcttcttcacgaatcgcaaaaacatgtactccgacggtgaagaatccacagctatcgcttaccgctgcattaacgaaaatttaccgaagcatctggacaatgtcaaagcattcgaaaaggccatcagcaaactttcgaagaacgcggtggacgacttagatacgacatactcaggcttgtgtgggacaaatttgtacgacgtcttcacggtggattacttcaatttcctgctgcctcagagtggcattaccgaatataataaaattatcggtggttacacgacctcagacggcacgaaagttaaggggatcaatgaatatattaatttgtacaatcaacaagtgtcgaagcgttacaaaatcccaaatcttaagatcttgtataagcagatcctttctgaatctgagaaagtttcgttcattccgccaaagttcgaggatgacaacgagttgctgtcagcggtgtccgaattttacgcgaatgacgagacgttcgacgggatgccgttgaaaaaagcaattgatgagacaaaacttcttttcgggaatctggataatagttctctgaatggcatttatattcagaacgaccgctctgtgaccaatttgtccaattcaatgtttgggtcatggtcagtgatcgaagacctttggaacaagaactatgattcagttaattccaactctcgtattaaggatatccaaaagcgcgaagataaacgcaaaaaggcttacaaggcggagaagaagttgagcctgtccttccttcaggtgttgatcagtaacagtgagaacgatgaaattcgcgagaaatctattgtagactactataagacttctttgatgcaactgaccgataacttatccgataagtataaggaagcagcgccacttttcaacgagagttatgcgaacgagaaaggcctgaagaatgacgataagtcgatttcattgatcaaaaatttcttggacgcgatcaaagagattgaaaaatttattaaaccgctgtccgagactaacatcaccggcgagaaaaatgacttgttttattcccagtttacgcctttgctggacaacatctctcgcatcgacatcttatacgataaggtgcgcaattacgtaacgcaaaagccattctcgacagacaaaattaagctgaacttcgggaacagccagttacttaacggttgggatcgcaataaagagaaggattgcggcgcggtgtggttgtgtaaagacgagaagtattatcttgcgatcattgataaatcgaacaacagtattttggagaacatcgatttccaggactgtgatgaaagtgactgctacgaaaagatcatttataaactgttaccaggccccaataaaatgcttccgaaggtttttttcagcgaaaaatgcaaaaagcttttgtccccaagtgacgaaattcttaagattcgtaaaaacggtactttcaaaaagggcgataaattcagcctggatgactgccacaagctgatcgatttttataaagaatccttcaaaaaatacccaaactggttaatttataactttaagttcaaaaagacaaatgagtacaatgatatctccgagttttataatgatgtagcgtcccagggatacaacatctcaaaaatgaaaatccccactagctttatcgataaattagtcgatgagggtaaaatttatttatttcaattgtataacaaagattttagcccgcattcgaaaggtacgcctaatcttcacaccctttattttaaaatgctttttgacgaacgtaaccttgaggatgttgtatacaaattgaacggagaggcggagatgttttatcgccccgcgtccattaaatatgacaagccgacgcacccgaaaaacacaccgatcaaaaacaagaacactttaaacgataaacgcgcgtcaacgtttccttacgacctgattaaagataaacgctacactaagtggcagttctccttgcacttcccgatcactatgaactttaaggcacccgatcgcgcaatgatcaacgatgatgtccgcaatctgttaaagagctgcaacaataatttcatcattggaattgaccgcggtgagcgtaatcttttatacgtgagcattattgactccaacggcgcgattatctatcaacactctttgaatatcattggcaataaatttaaaggtaagacttacgagactaattatcgcgagaaacttgagacccgtgagaaggagcgtacagaacaacgtcgcaattggaaggctattgaaagcattaaggagttgaaagaaggttacatctcacaggctgtacacgtaatctgtcaattagtcgtcaaatatgatgcaatcattgttatggagaaattgaccgacggcttcaaacgtgggcgtacgaaatttgaaaagcaagtgtaccaaaagtttgaaaaaatgttaatcgacaaactgaattactacgtggacaaaaagcttgatcctgacgaagaaggcggactgctgcatgcttaccaattgacgaataagcttgagagtttcgataaactggggatgcagtccggttttatcttctacgtgcgtcctgactttacctccaaaattgatcctgtaacaggttttgtcaacttgttgtatccgcgctatgaaaatatcgacaaggctaaggacatgatttctcgtttcgacgacattcgttataacgcgggggaagatttttttgaatttgatatcgattatgacaagttccctaaaacagccagcgactaccgcaagaagtggacaatttgtactaacggagaacgcattgaagcgtttcgcaatccagcatctaacaatgagtggtcttatcgcacgatcattctggcagaaaagtttaaggagctgtttgacaacaactcaatcaattaccgtgatagcgataatttaaaagctgagattctgagccagacaaaaggtaagttttttgaggactttttcaaattgttacgtcttacgttacagatgcgcaattctaacccggaaactggagaagatcgtattttgtcccccgtgaaagataaaaacggaaacttttatgacagttctaaatacgatgagaaatctaaccttccgtgcgatgcggacgcaaatggcgcgtataacatcgcacgtaagggactgtggattgtggaacaattcaaaaagtcagataatgtgtctacggtcgaaccggtcatccataacgacaagtggctgaagttcgtccaagaaaatgatatggccaacaattaa

SEQ ID NO: 917 - DNA, 3738 bp, synthetic construct
  misc_feature 1..3738: note = Description of Artificial Sequence: Synthetic polynucleotide
  source 1..3738: mol_type = other DNA
atgcaggaacataagaagatcagccatttgacacatcgcaacagcgtgcagaagacaattcgtatgcagctgaatcccgtcggcaaaaccatggattatttccaagctaaacagattttggaaaacgatgaaaaattaaaagaagactatcaaaaaatcaaggagatcgcggatcgtttctatcgtaatcttaacgaggacgtcttgtcgaagacaggattagacaagctgaaagactatgcagaaatctattatcactgcaataccgacgcagatcgtaaacgcctggatgaatgtgcttctgagcttcgcaaggaaatcgtcaagaacttcaagaaccgcgatgagtataataagttgtttaacaagaagatgattgaaattgtattgcctcaacacttgaagaacgaggatgagaaagaggtcgtcgcttccttcaaaaactttactacatatttcacaggattcttcaccaatcgcaagaatatgtattctgatggtgaggagtcaacggcgattgcctaccgttgcatcaatgagaacctgccgaaacacctggacaatgtgaaagcgtttgaaaaagccatttctaagctgagtaagaacgcagtcgatgaccttgacaccacctattcaggattatgcggaactaatttatacgacgtcttcactgttgattactttaattttcttttgcctcagagcggaatcactgagtacaacaaaattattggaggatacacaacttctgacggcaccaaggtaaaggggattaacgaatatatcaatctttataatcagcaagtgtctaaacgctacaaaatcccaaacttgaagatcttatacaagcagatcctttcagagtcggaaaaggtttcgttcatccctccaaagttcgaggacgataatgagttgttgtcggctgtatcggagttttatgccaatgatgagacgtttgatggtatgcctcttaagaaggcaattgacgaaacaaagttgctgtttggcaatttggacaatagtagtcttaatgggatctatatccaaaatgaccgctcagttacgaaccttagcaactctatgtttggctcttggtctgttattgaagacctgtggaacaaaaattacgattcggtgaactcaaattcgcgtatcaaggatattcaaaagcgcgaggacaagcgtaaaaaagcgtacaaggcggaaaagaagttgtcactttcgttccttcaggtccttatctcaaactccgaaaacgacgaaattcgcgaaaagtcgatcgtcgattactataaaactagccttatgcagttaacggataatctgtctgacaagtataaagaggcagcacctctgtttaacgagagctacgcgaatgaaaagggtcttaagaacgatgataagtccatttcgttaattaagaattttttagacgctattaaagagatcgagaaatttatcaagccactttcagagactaatattacgggtgagaaaaatgatctgttctattcacaattcacgccgctgttggataacatttcgcgcattgatatcctgtatgataaagtgcgtaactacgtgacgcagaaaccattttcgaccgacaaaatcaaattaaacttcggtaactcgcagttgctgaatggttgggatcgcaacaaggagaaagactgtggcgctgtatggctttgcaaagacgaaaaatattacttggcaattatcgacaaatctaataattctatcttagaaaacatcgacttccaagattgtgatgaatcggattgttacgagaaaattatttataagttattacctggtccaaacaaaatgctgcccaaggtttttttttccgaaaaatgtaagaagctgttaagtccaagtgatgaaatcttgaaaatccgcaaaaacggcactttcaaaaagggagacaagttctcactggacgattgccacaaactgatcgatttctacaaggagtctttcaagaaatatccgaattggttgatttacaactttaaattcaagaaaacaaatgagtataacgacatcagcgagttttataatgatgtcgcctcgcaaggttacaacatttcaaaaatgaagatcccaacgagcttcatcgataaacttgtagatgaaggaaaaatttacctgtttcaattatacaacaaagacttcagcccgcattcgaagggaacccccaaccttcatacgctgtatttcaagatgttattcgatgaacgcaacttagaagatgtggtctacaaattaaacggagaagcagaaatgttctaccgccccgcgtcgattaaatatgacaagcccacgcacccgaagaacactccaattaagaataagaacactctgaatgacaagcgtgcttctacgttcccctatgatttaattaaagacaaacgttatacgaagtggcagttttctttacacttccctatcacaatgaattttaaagcccccgatcgtgctatgatcaatgatgacgtgcgtaacttgttgaaatcctgcaacaataatttcattatcggtattgaccgtggcgagcgcaatctgctttacgtcagcattattgattcgaatggcgccatcatttatcagcactcgctgaacatcatcggtaataagtttaagggaaaaacttatgaaactaattaccgtgagaagctggagactcgtgagaaggagcgcacggagcagcgtcgcaattggaaagcaattgagtcgattaaggagcttaaggagggttacatcagccaagcagtccacgtgatttgccaactggttgtgaaatacgacgccatcattgtcatggagaaattaacagatgggtttaagcgtggtcgtactaagtttgaaaaacaagtatatcaaaaattcgagaaaatgctgatcgacaaattgaattattacgttgataagaaattggatccggacgaagagggaggccttttacatgcatatcaactgacaaataaactggaatccttcgataaattggggatgcagagtggatttatcttttatgtgcgtcctgacttcacatccaaaattgaccctgtgactggcttcgttaatttattatacccgcgttatgagaacattgacaaagcaaaagatatgatttcgcgctttgacgatattcgctacaatgccggagaggatttttttgagtttgacatcgactacgacaaattccctaagacggcgagtgactatcgcaaaaagtggactatttgtacaaacggcgagcgtatcgaggcgttccgcaatccagcctcgaataatgaatggtcgtaccgcacgatcatcctggctgaaaaattcaaggaattatttgacaataatagtatcaactaccgcgattccgataatcttaaagctgagatcttatcccagacgaaaggaaaatttttcgaggactttttcaaactgctgcgccttacgttgcaaatgcgcaattccaaccctgaaaccggcgaagatcgcattctgagccccgtaaaagataagaatggcaatttctacgactcttcgaagtacgacgagaaatctaaccttccctgtgatgcggacgctaatggtgcatacaacattgctcgcaaaggactgtggattgttgagcaatttaagaagtcggacaacgtaagtaccgttgaaccggtgattcataacgacaagtggctgaaattcgtgcaagaaaacgatatggccaacaactaa

SEQ ID NO: 918 - DNA, 3816 bp, Leptospira ryugenii
  source 1..3816: mol_type = genomic DNA
atgaagaatctcgcaaactttacaaatttatacagcttacagaaaacacttcgttttgaactaaaaccaattggaaaaactttagactggatcatcaaaaaggatcttttgaagcaggatgagattcttgcagaagattataaaatagtcaaaaagattatagatcgttatcataaagatttcatagaccttgcatttgaatccgcctatctacaaaagaagtcctccgattcctttaccgcgatcatggaagcatctatccaatcgtattctgaactttattttataaaagaaaagtctgacagagataagaaagccatggaagaaatttccggaataatgcgaaaagaaatagtagaatgttttactggaaagtatagcgaagttgttaaaaagaaatttggcaatcttttcaaaaaagagcttatcaaagaagatttactgaatttttgcgaaccagatgaattacctatcatccaaaagtttgcggacttcactacctattttactggatttcatgaaaatcgggagaatatgtattctaatgaggagaaagcaacagctattgccaatcgactcatccgcgaaaacctaccgagatatctagataacctaaggatcattcgatcaatccaaggcagatacaaagattttggttggaaagatttagaatccaatctgaagcggattgataaaaatctccaatattcggatttccttacagaaaatggctttgtgtacactttttcccaaaaaggcatagaccggtacaatttgatcctgggagggcaatcggtcgagtcgggagagaagatacaaggacttaatgaacttatcaatttgtatagacaaaagaatcaattggatagaagacaacttccaaatttaaaagaactgtataagcagatacttagtgatcgaactagacattcttttgtaccagagaagttttcatctgataaagcactgttgcgatctcttctggattttcacaaagaagtgattcaaaataaaaatttatttgaggagaagcaggtaagccttttacaggcaatcagggagacacttactgatttaaaatcctttgacctagataggatatatttaacaaacgacacaagtctcactcaaatttcaaattttgtatttggtgattggtcaaaagttaagacaatactagcaatctatttcgatgaaaacatagctaatcctaaagacagacaaaggcaatcgaattcatatctaaaagcaaaggagaattggctcaaaaaaaattattattcaatacacgaattgaatgaggcaatttcggtatatggaaaacattctgatgaggaattgcctaacacaaagatcgaagattatttctctggtcttcaaactaaagatgagactaaaaagccaatagatgtactcgatgcaattgtctctaaatatgctgacttagagagtttgcttacgaaggaatatcctgaagataaaaatttaaaatcagataaaggtagtatcgaaaaaatcaagaactacctagattcgattaaactattacaaaattttttaaaacctctaaaaccaaagaaggttcaggatgaaaaggatttaggcttctacaatgatcttgaactttatctggaatcactagaatcagctaatagcctttacaataaggtgcgaaactatctaactggaaaagaatactcagatgaaaaaatcaaattaaattttaagaactctacacttcttgatggatgggatgagaacaaagaaacatcgaatttgagtgttatcttccgagataccaacaattattatttagggatactggataaacaaaacaatagaatttttgaatcaataccagaaatccaatctggggaagaaacgatccaaaaaatggtttataaattacttccgggcgcaaataatatgcttccaaaagtattcttttcagaaaaaggattattaaaatttaatccttctgatgaaattacctcattatattctgaaggcagatttaaaaaaggagataaattcagtatcaattcactccatacactcatagatttttataagaaatctttggcagtgcatgaggattggagtgtttttaatttcaaatttgatgaaactagtcattatgaagatatctcacaattttatagacaagttgaatcacaagggtataagataacattcaaaccgatttcaaaaaaatatattgatactttggtagaagacggtaaactatatctctttcagatttacaataaggacttttctcaaaataaaaaaggtggcggaaaacctaatttacataccatttactttaaatctttatttgaaaaagaaaacttaaaagacgttattgttaagttaaacggacaggcggaagtattttttcgcaaaaaatctatacactatgatgagaatatcacacgatacggacatcattctgaactcctaaaaggaagattcagctaccctatccttaaggacaaacgattcacagaagacaaatttcagtttcactttcccatcacactcaattttaaatcaggagaaatcaaacagttcaatgcacgagtaaattcctatctgaaacataacaaagatgtgaagatcattggaattgatcgcggggaacgccacttgctgtatctatctttaatcgaccaagatgggaaaatacttcggcaagaatccttaaacttaataaaaaatgaccaaaattttaaagccataaattatcaagagaaattgcacaaaaaagagatagaaagagatcaggcaagaaaatcgtgggggtccatcgagaatataaaagagttaaaggaaggctatctgtcccaagtggtacatacaatttcaaagttgatggtagaacacaatgccattgttgttctagaagatttaaattttggatttaaacgtggtcgccagaaagtagaacggcaagtctatcagaaattcgaaaaaatgctcattgaaaagctaaattttttggttttcaaggataaagaaatggatgaaccaggaggtatcctaaaagcataccaactaacggataactttgtgagctttgaaaaaatgggaaaacaaacaggttttgttttctatgttcctgcttggaatacaagtaaaatcgatcctaaaacaggtttcgtcaattttttgcatctaaactatgaaaatgtaaaccaagcaaaagaattgatcgggaaatttgatcaaattcgatataaccaagatagagattggtttgaatttcaagttacgactgaccaattctttactaaagagaatgctccagatacgcgtacctggataatttgttcaaccccaaccaaacgtttttattcaaaacgaacagtgaatggttctgtttcaacaatagagatagatgtgaaccaaaagttaaaagaacttttcaatgattgcaattaccaagatggtgaagatttagtagataggattcttgagaaagattccaaagattttttttcgaagctcattgcctatttacgaatccttacatcgcttcgtcaaaataatggtgaacagggttttgaagaaagggattttatactctctccggtggtgggcagtgatggtaaattctttaattcactagatgctagttctcaagaaccaaaggatgcagatgcaaacggcgcctaccatatcgcattaaaaggattgatgaatctacatgttatcaatgaaaccgatgatgaatccttaggtaaaccgagttggaaaattagcaacaaagactggctaaattttgtatggcaaaggccaagcttgaaagcataa

SEQ ID NO: 919 - DNA, 3816 bp, synthetic construct
  misc_feature 1..3816: note = Description of Artificial Sequence: Synthetic polynucleotide
  source 1..3816: mol_type = other DNA
atgaagaacttagccaactttacgaatttatatagccttcaaaaaactttacgtttcgaattgaagccaattggaaaaacacttgactggatcatcaaaaaagatttgttgaaacaggatgagattctggcagaagattacaaaatcgttaaaaagattattgaccgctaccacaaggattttattgaccttgcattcgagtctgcttacctgcaaaaaaaatctagcgacagctttacggcaattatggaagccagcatccagtcatactctgagttgtattttattaaggaaaagtctgaccgtgacaaaaaagccatggaggaaatctctgggatcatgcgtaaggaaatcgtcgagtgctttacgggtaagtattcggaagttgttaaaaaaaaatttggaaatctttttaagaaggagctgatcaaggaggacttattaaacttttgcgagcccgatgagctgcctattattcagaaattcgcggactttacgacttatttcacaggcttccacgagaatcgcgagaatatgtattccaatgaagaaaaagcaactgcgatcgcaaaccgtctgatccgtgaaaatcttcctcgttatcttgacaacctgcgcatcattcgcagtatccaagggcgttataaagactttgggtggaaggaccttgaaagtaaccttaaacgtattgataagaaccttcagtattccgacttccttactgaaaatgggttcgtctacaccttctcacaaaagggcatcgaccgttataatcttatcttaggaggtcaatcagtggagtccggggaaaaaatccagggccttaacgaacttattaacttgtaccgtcagaagaatcagttagatcgccgtcaacttccgaaccttaaagagttgtacaagcaaattttgtccgaccgcacccgtcacagttttgtcccagaaaagttcagcagcgacaaggcgcttttacgctcacttcttgactttcataaagaagttattcaaaacaaaaacctgtttgaagaaaaacaagtatcgttactgcaagctatccgcgagaccttgaccgacttaaagtcttttgatcttgatcgcatctatttaaccaacgacacatccttgacccaaatttcaaactttgtcttcggcgattggtccaaggttaaaactattttggctatttactttgacgaaaatattgctaatcccaaagatcgtcaacgtcagtccaattcatatttaaaggcaaaagagaattggctgaaaaagaattactatagcattcatgagctgaacgaggcgatttccgtatacgggaaacattctgatgaggagcttcctaacactaagattgaggattacttctccgggttacagaccaaggatgagaccaagaagccaatcgatgtgcttgatgctatcgtatcaaagtatgcagacttggagtccctgcttacgaaagaatatcctgaagataaaaatttaaaatccgataagggttcgattgaaaagattaagaattacttggactcgattaagttgttacagaacttcctgaagcctttgaagcccaagaaagtacaggatgagaaggacttgggcttctataacgatctggaattatacttagagagccttgagtccgccaacagcctgtacaacaaggtacgtaattacttgacagggaaagaatatagtgacgagaagattaagcttaactttaaaaatagcacccttcttgacgggtgggacgagaacaaggaaacctctaaccttagtgtcattttccgcgatactaacaactactacctgggtattttggacaaacagaataatcgtatcttcgaaagcattccagagatccagtcaggcgaggaaaccatccagaagatggtctataaacttcttcccggtgcaaacaatatgttaccgaaagtctttttctccgaaaaaggattgcttaaattcaatccctcagatgagatcacttcattgtattcggaagggcgttttaagaagggtgataaattttcgattaacagcttacacaccctgatcgacttctacaaaaaaagcctggccgttcacgaagactggtccgttttcaactttaagttcgacgaaacttcgcactatgaggatatctctcaattctatcgtcaggtcgaaagtcaggggtacaaaatcacgttcaaacccattagtaaaaaatacattgataccttggtggaggacggcaaattgtacttgttccaaatctacaataaggatttctcccagaacaaaaaaggtggtggcaaaccaaatttacataccatctacttcaagagtcttttcgaaaaggagaatttaaaagatgtcattgttaagttaaatgggcaagcggaggtgttctttcgcaagaagtccattcattacgacgagaatattacgcgctacggacaccatagtgaacttcttaagggccgctttagctacccgatccttaaagataagcgttttacggaggataagtttcagttccactttccgattaccctgaactttaagagcggcgagattaagcaatttaatgctcgcgtcaactcctaccttaagcacaacaaagacgttaagatcattggtatcgatcgcggagaacgtcacctgctgtatttatccttaatcgaccaagatgggaagatcttacgtcaggaatctttgaatcttatcaaaaacgatcagaattttaaggctattaattaccaagaaaagttgcataagaaagagattgaacgcgaccaggcacgcaagagttgggggtcaattgaaaacatcaaggaattaaaggaaggttaccttagccaggtagtgcatacaatctccaagctgatggtagagcacaacgcaatcgttgtattggaagatttaaatttcgggttcaaacgcggtcgccagaaagttgagcgtcaagtataccaaaaattcgagaagatgttgattgagaaacttaactttttagtgtttaaggacaaagagatggacgaaccaggcgggattttaaaagcgtatcaattgactgataacttcgttagttttgagaagatgggcaagcagaccgggtttgtgttctatgtccctgcctggaacacctctaaaattgatccaaagaccgggttcgtcaacttccttcatttaaattacgagaatgttaaccaggcaaaagaattaattggcaaatttgatcagattcgctacaaccaggaccgcgattggttcgagtttcaagttaccacagaccaattcttcaccaaggaaaatgccccagacacccgtacctggattatctgctctactcctacaaagcgtttttactcaaagcgcacggtaaatggttcggtgtcgacgattgagattgatgtaaatcagaagctgaaagaattgtttaatgactgtaattatcaagatggggaggatttagtcgatcgcatccttgagaaggacagtaaggactttttttcgaaacttatcgcgtatttgcgcatcttaacgtcattacgtcaaaacaacggagaacaaggcttcgaggagcgcgactttatcctgagcccggtggttggctcagatgggaaattcttcaattccttggatgctagttcacaggagcctaaagatgcggatgcgaatggagcctatcatatcgctctgaagggcctgatgaacctgcacgttatcaatgagacagatgatgagtcccttggaaaaccgtcttggaagatttccaacaaggattggttaaatttcgtatggcaacgtccaagtctgaaagcttaa

SEQ ID NO: 920 - DNA, 3816 bp, synthetic construct
  misc_feature 1..3816: note = Description of Artificial Sequence: Synthetic polynucleotide
  source 1..3816: mol_type = other DNA
atgaagaatttagcaaacttcaccaacctttacagcttgcaaaagaccctgcgtttcgaattaaagccaatcggcaagaccctggactggatcatcaaaaaggaccttcttaaacaggacgagattttggccgaagactacaaaattgtaaaaaagatcatcgaccgctaccacaaagactttattgatttggcgtttgagtccgcgtacttacagaaaaagtcatcagatagctttacggctatcatggaggcgtccatccagtcgtattccgagctgtattttatcaaggagaaaagcgaccgtgataaaaaagcgatggaagaaatttcagggatcatgcgcaaggagattgtcgaatgtttcacagggaagtacagcgaagttgtaaagaaaaagtttggtaacttgtttaagaaggagttgatcaaagaggatctgctgaacttctgtgaacctgacgaattacccattatccaaaaatttgcagactttacgacatatttcacagggtttcacgagaatcgtgagaatatgtactcaaatgaagaaaaggcaactgcgatcgctaaccgcttgatccgtgaaaacttaccacgttatcttgacaacctgcgtattatccgctcaattcagggccgctacaaagactttggatggaaggacttagagtcaaatttaaaacgtattgacaagaacttacagtattcggattttctgacggagaatggtttcgtttatactttttcccaaaagggaatcgaccgctacaacttgattttggggggccaaagtgtcgagtctggagaaaagatccaaggactgaatgaacttatcaacttgtaccgccaaaagaatcaactggaccgccgtcagttaccgaacttgaaggagctttacaaacagatcctgagcgaccgcacccgtcattcattcgtgccagagaagttctcgtcggacaaggcactgttgcgcagtttgttggatttccacaaagaggtgatccagaataaaaatcttttcgaggagaaacaagttagcttgctgcaagctatccgtgaaacccttaccgatcttaaatcgttcgatctggaccgcatctaccttacaaacgatacgtcactgacccagattagcaatttcgtatttggtgactggagtaaggtgaagacaattttagccatctacttcgacgagaacatcgcgaatcctaaggaccgccagcgccaatctaactcgtatcttaaagcaaaggaaaattggctgaagaagaattactatagcatccatgaattgaacgaggcgatttccgtatacgggaagcattcagatgaagagctgccgaacaccaaaatcgaagactacttctcggggttgcaaactaaagatgagactaaaaagccaattgatgttttggacgccattgtgagtaagtacgcggaccttgagagtctgttaacgaaggagtatccggaagataaaaacttaaaaagtgacaaaggctcaatcgagaagatcaaaaattacttggatagtattaagctgcttcaaaatttcctgaagccgcttaagcctaaaaaagtacaggacgaaaaagatttggggttttataatgacttggaactttacttagaatcactggagtccgcaaattcactttataacaaagtccgtaattatctgaccggaaaagaatactcagatgagaagatcaagttgaacttcaagaactcaactcttttagacgggtgggacgagaacaaggaaacaagtaacctgtctgttatttttcgtgacacgaacaattattatcttgggatccttgacaagcaaaacaaccgtatcttcgaatccattcccgagatccagagtggcgaggagaccatccagaagatggtctataagttgttgcccggagcgaataacatgcttccgaaagtctttttctctgagaaaggcctgcttaaattcaacccctcggacgagattacgtccctgtactcggagggccgcttcaaaaaaggggataagttttcaatcaattctctgcacacgttaattgacttttacaaaaaatctttagcggtgcatgaagactggtctgtctttaatttcaaattcgacgaaactagtcattatgaagatatttcacagttttaccgtcaggtagaaagccagggatacaaaatcacatttaaacctatctcgaaaaagtatatcgatacgttagtagaggacggcaagctttatctttttcagatttataataaggatttctctcaaaacaagaagggaggcgggaagcctaaccttcacaccatttattttaagtccttatttgagaaagaaaaccttaaggatgttatcgtgaaactgaacggtcaggccgaggtatttttccgcaaaaaaagtattcattacgatgagaacatcacacgttacggacaccattctgagcttctgaaagggcgcttctcctacccaatcctgaaagacaagcgtttcactgaggataagttccaattccatttccctatcacgttgaatttcaaatccggcgaaatcaagcagtttaatgcgcgcgttaactcctaccttaaacataataaagacgtcaagatcattggcattgatcgtggcgagcgccacttactttaccttagtctgattgatcaagatggaaagattcttcgtcaagaaagtttaaatttgatcaagaacgatcaaaacttcaaagccatcaattatcaggagaaattacataaaaaggaaatcgaacgcgatcaggctcgcaagtcttggggatcgattgaaaatattaaggaattgaaggagggctatttgagccaggtggtgcatacgattagcaaattgatggtcgaacacaatgcgatcgtggttcttgaagatctgaactttgggttcaagcgtgggcgtcaaaaggtcgaacgtcaagtgtatcagaaattcgagaagatgcttatcgagaagttaaattttttggtttttaaggataaagagatggacgaaccgggtgggattttgaaggcttatcaattgaccgataacttcgtctcattcgaaaagatgggcaaacagacgggctttgttttttacgtcccggcatggaacacgtcaaagattgatcctaagactgggtttgttaattttttgcatcttaactacgagaatgtgaatcaggcaaaggaattaattggtaagtttgatcagattcgctataatcaggatcgtgattggttcgagttccaggttactacggaccagtttttcaccaaggagaatgcgcctgacacacgtacctggatcatctgctctacccccaccaaacgtttctacagtaaacgtactgtcaatggaagcgtctctaccattgaaatcgacgttaatcaaaaattgaaagagttgtttaatgattgtaactatcaagatggggaagatttagttgatcgcatccttgaaaaggattcgaaggatttcttttcaaagttaattgcctatctgcgcatcttgacttcgttacgccaaaacaatggcgaacaaggctttgaagaacgtgattttatcctgtcacctgttgttggtagcgacggtaagtttttcaactcgcttgacgctagttctcaggaacctaaagatgcggacgctaacggagcgtatcatatcgcccttaaaggtctgatgaatctgcacgtcattaatgagactgacgatgaatcattaggaaaacccagttggaagattagtaataaagattggttaaactttgtatggcaacgcccatctcttaaagcgtaa

SEQ ID NO: 921 - DNA, 3816 bp, synthetic construct
  misc_feature 1..3816: note = Description of Artificial Sequence: Synthetic polynucleotide
  source 1..3816: mol_type = other DNA
atgaagaaccttgctaatttcacgaatctttattcgctgcagaagacgcttcgctttgagttaaagccgatcggtaagaccttggattggatcattaagaaagacttgctgaagcaagacgagattttagccgaagactacaagattgtgaagaagattattgatcgttatcataaagattttattgatctggcgttcgaaagcgcatacttacagaagaaaagctccgatagtttcactgcgattatggaagcaagcattcaatcttactcggagttatactttatcaaagaaaaaagtgaccgtgataagaaggcaatggaagaaattagtgggatcatgcgtaaagagatcgttgaatgcttcacgggaaagtattccgaggtagttaagaagaaatttgggaatttgttcaaaaaagaactgattaaagaagatttattgaatttttgtgaaccggatgaattgccgatcatccaaaagtttgccgacttcactacttatttcacgggatttcacgaaaatcgcgagaatatgtattccaacgaagagaaagcaactgctattgcgaaccgtcttatccgcgaaaatttaccccgttacctggacaatttacgtattatccgcagtattcaggggcgctacaaagatttcggatggaaggacctggagtccaatttaaaacgtatcgacaaaaacttacaatacagtgattttcttaccgagaatggatttgtgtacactttctcccagaaagggatcgaccgttacaacttgatcctgggcggccaatccgtagaaagtggtgagaagatccagggacttaacgaattgattaatctttaccgccaaaagaaccaattagatcgtcgtcagcttcctaatctgaaggagttgtataaacagattctgtccgatcgtacccgccactcttttgtccccgagaaattctcgtctgacaaagcactgttacgtagtcttctggacttccataaagaggtgatccagaataaaaatttattcgaagaaaagcaggtctctcttttgcaagccattcgcgaaaccttgaccgacttaaaatctttcgatttagatcgtatttatttaacgaacgacacgtcgttgacacagatctcgaacttcgtatttggcgattggtccaaggtgaaaaccatccttgccatctattttgatgaaaatattgccaatcctaaagaccgccaacgccagtcgaatagttatttgaaggccaaagagaactggttaaaaaaaaactattactccatccacgagctgaacgaagctatttcagtatacggaaagcacagtgacgaggagttaccaaatacaaagatcgaagactatttctccggtctgcaaacaaaagatgagactaaaaaaccgattgatgttttagatgcgatcgtctccaagtatgcagatctggaatctcttttgacaaaggaatatccagaagacaaaaatttgaagtctgataagggttcgattgaaaagattaagaattatttagactcgatcaagcttttgcaaaattttcttaaacctttgaagccaaaaaaggtgcaggatgagaaagatcttggcttctacaatgatttagagctgtacctggaatcgctggaatcggcgaatagcttgtataacaaggtccgcaattatcttactggaaaagaatattccgatgaaaaaattaaattaaatttcaaaaatagtactttattagatgggtgggatgagaataaggaaaccagcaacctgtccgtcatttttcgtgacacaaacaattactatctgggaatcctggacaaacagaacaatcgcatctttgagtcaatcccagagatccaatcgggcgaggagactattcaaaagatggtatacaaattattgcccggcgcaaacaatatgctgcccaaggttttcttttcggagaaggggctgctgaaatttaacccgtcggacgaaattacctcattatattcggagggacgtttcaaaaaaggcgataagttctcaattaattccttacacacacttatcgacttctacaaaaaaagtcttgctgttcatgaagactggtcagtatttaacttcaagttcgacgaaacttctcactatgaggacatcagtcagttttaccgccaagtcgaatcacagggctataaaatcacatttaagcccatcagtaagaagtatatcgataccttggtagaagacggcaagttatatttgtttcagatttataataaagacttttcgcaaaacaagaaaggaggaggaaaaccgaatcttcacaccatttattttaaatctcttttcgaaaaggaaaatttaaaggacgtcatcgtaaaacttaatgggcaggcggaagtctttttccgtaagaaatcaattcattatgacgagaatatcacgcgctatgggcatcattccgagcttttgaagggacgcttctcttacccgatcctgaaggacaaacgcttcactgaagacaaatttcaatttcacttccctatcacattgaactttaaatcaggagaaattaagcagtttaatgcacgcgtaaactcttaccttaagcacaataaagatgttaaaatcattggaattgaccgtggagagcgccatttactttaccttagcctgatcgatcaagacgggaagatccttcgccaagagagccttaaccttattaagaatgatcagaatttcaaggccattaattatcaagagaagttacacaagaaggagattgaacgcgaccaagcccgtaagtcctggggtagcattgaaaacattaaggagctgaaggagggatatttgtcgcaagtagtgcatactatctcgaagttaatggtggaacataatgcaatcgtggtcttagaggatcttaatttcggattcaaacgtggtcgtcaaaaggtagaacgtcaagtctaccagaaatttgaaaagatgctgatcgaaaaattaaatttccttgtgttcaaggacaaagaaatggacgagccaggaggaattctgaaggcgtaccagctgactgataatttcgttagcttcgagaagatggggaaacaaacaggattcgtgttttatgtgccggcttggaatacttcaaaaatcgacccgaaaactggtttcgttaattttctgcatttgaattacgagaacgtcaaccaggcaaaggaattaatcggaaagtttgaccaaatccgttacaatcaggaccgtgattggttcgaattccaagtcaccacagatcagttttttacaaaagaaaacgcaccggacacacgcacctggattatctgttcaacccctactaaacgcttctattcgaaacgtaccgtcaatggttccgtgagtactatcgagattgacgtcaaccagaaactgaaagaattgttcaatgattgcaattatcaagatggcgaagacttagtggatcgcattctggaaaaagactctaaggacttctttagtaagttaattgcgtaccttcgtatcttaacctcgttacgccagaacaacggagaacagggcttcgaagaacgtgacttcatcttatctcccgtggtcggctcagacggtaagttttttaattcactggacgcgagctctcaagagcctaaagatgccgacgctaatggagcctatcatattgcgttaaaaggactgatgaacctgcacgtgatcaacgaaaccgacgatgaatccttgggcaagcccagctggaagatcagcaacaaagactggttgaattttgtatggcagcgcccctcattgaaggcgtaa

SEQ ID NO: 922 - DNA, 3738 bp, Ruminococcus sp.
  source 1..3738: mol_type = genomic DNA
atgcaagagcataaaaaaatatcgcatcttacacacagaaattcagttcaaaaaacaattaggatgcaactgaatcctgtaggtaaaacaatggattattttcaagcaaagcaaattcttgaaaatgatgaaaagcttaaagagaactatcagaaaatcaaggaaatagcagacaggttttacagaaatttaaatgaggatgtactttcaaaaaccaggttagataaattaaaagattatactgatatttactatcactgtaatacggatgcagaccgaaaaagacttgatgaatgtgcatcggaattaaggaaagaaatcgtcaaaaattttaagaatagagatgagtataacaaactattcaataaaaagatgattgagatagttcttcccaaacatcttaaaaatgaggacgaaaaggaagttgtaacctcatttaaaaatttcacaacatactttacaggtttcttcactaacagaaaaaatatgtattcggacggagaagaatccacggcaatcgcatatagatgcattaacgaaaatttgcctaagcatcttgacaatgtcaaggcctttgaaaaagcaatttctaaactatccaaaaacgcaattgatgatttagataccacttattccggcttatgtggtacaaatttgtatgacgtttttacagttgattattttaactttttgcttccacaatccggaattaccgaatataacaaaatcatcggcggttacacaacaaacgacggtacaaaagttaagggtattaacgaatatataaatttgtacaatcaacaagtatccaaacgggataaaattcctaatcttaaaattttgtataaacaaattttaagtgagagtgaaaaggtatcattcataccgccaaagtttgaagatgacaacgaacttttatcggctgtttcagagttttacgcaaacgacgaaacctttgacgggatgccattaaaaaaagcaattgatgaaacaaagctattattcggcaatttagataatccctctcttaatggaatttacattcaaaatgaccgatccgtgacaaatctgtcaaacagtatgttcggttcttggtcggtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttccaattctgaaaatgatgaaatcagagaaaagtctatcgtagattactacaagacttctttaatgcaacttaccgacaatttgtcagacaaatacaacgaagcagcacctctgctcaatgagaattactctaatgaaaaaggtttgaaaaatgacgataaatctatttcattaattaaaaattttcttgatgccataaaagaaattgaaaaattcataaagcctttgtccgaaactaatattacaggtgagaaaaatgatttgttttacagtcagttcacaccattacttgataatatcagcagaatagacatattatatgataaggtcagaaactatgttacacaaaaaccgttttcaacagataaaatcaagcttaactttggcaattcacagctattaaacggctgggatcgaaacaaagaaaaagactgcggtgccgtttggctttgtaaagatgaaaaatattatcttgcaatcatagataaaagtaataatagtattttggaaaatattgattttcaagactgcgatgaaagcgattgttatgaaaagataatttacaagcttctccccggtccaaataaaatgcttccaaaagttttcttttcagaaaagtgcaagaaacttttgtcaccgtcagacgaaatacttaaaatttataaaagcggcactttcaaaacaggtgataagttcagccttgatgattgccataagttaattgatttctacaaagaatcattcaaaaagtacccaaattggttaatttataactttaaattcaaaaaaacaaacgaatataacgatatccgcgaattttataatgatgttgctttacagggatataatatttcaaaaatgaaaatcccgacatcatttattgacaaacttgtagatgaaggaaaaatctatcttttccaactctacaacaaagacttttcaccgcatagcaagggtactcctaatctgcatacactttattttaaaatgttgtttgatgaaaggaatcttgaagatgtggtgtacaggcttaacggtgaggcagaaatgttttatcgtcctgcaagtataaaatatgacaaaccaactcatcccaaaaacacaccgataaaaaacaaaaatacactcaatgataaaaaaacaagcacttttccttatgacttaatcaaagataaacgctacactaaatggcagttttcacttcacttccctattaccatgaattttaaagctccggataaggcaatgatcaatgatgatgtcagaaatctgctgaaatcctgcaacaacaatttcatcataggaattgacagaggcgaaagaaacttgctttatgtcagcgtaattgacagcaacggtgctataatatatcagcactcactcaatattatcggaaacaagtttaaagaaaaaacatacgaaactaactaccgggaaaaacttgcaacaagagaaaaagagcgtacggaacagcgccgtaactggaaagcaattgagagtataaaagaactcaaagagggctatatcagtcaggctgtgcatgttatatgtcagcttgttgtcaagtacgatgcaatcatcgttatggaaaagctgactgacggattcaaacgaggcagaacaaagtttgaaaaacaggtttatcagaaatttgaaaaaatgctgattgacaaacttaattactatgttgacaaaaagcttgatcccgacgaagaaggcggtttacttcatgcctatcagcttacgaacaagcttgagagctttgataagcttggcatgcaaagcggttttattttctatgttcgtcctgattttacaagcaaaattgatcccgttaccggctttgtaaatttgttgtatcctcaatatgaaaacattgacaaagccaaagatatgatttcaagatttgacgaaataagatacaatgccggcgaggacttttttgaatttgacattgattacgatgagtttccaaagactgcgtctgactatcgcaaaaagtggacaatctgtactaacggcgaaaggattgaagctttcagaaatcccgcaaacaataacgaatggagttaccgtacaataattcttgcggaaaaattcaaagaattatttgataacaattctataaattatcgtgattctgacgatttgaaagctgaaattctttcacagacaaagggcaaattttttgaggatttctttaaattattaagacttaccctacagatgcgaaacagcaaccctgaaacaggcgaggaccgtattctttctcccgtcaaggacaaaaacggtaatttttacgacagttcaaaatatgatgaaaagagcaagcttccgtgtgatgccgatgcaaacggtgcgtacaacattgcccgcaaaggtttgtggattgttgaacaattcaaaaaagccgataatgtttcaactgtcgaaccggtaatccacaatgaccaatggctgaaatttgttcaggagaatgatatggcgaataattaa

SEQ ID NO: 923 - DNA, 3738 bp, synthetic construct
  misc_feature 1..3738: note = Description of Artificial Sequence: Synthetic polynucleotide
  source 1..3738: mol_type = other DNA
atgcaggaacataaaaagatttcacatctgacgcaccgcaattcagtacaaaagactattcgtatgcaattaaatcccgtgggtaaaaccatggattactttcaagcaaagcagattttggagaatgatgagaagttaaaggaaaattatcaaaaaatcaaggaaatcgcagatcgcttctaccgtaatctgaatgaagacgtactttctaaaacgcgcctggataaattaaaagactataccgacatttattaccactgcaacacagatgcggaccgtaagcgtctggacgaatgcgcctcagagctgcgcaaggaaatcgtcaaaaactttaaaaaccgcgacgagtataataagcttttcaataagaagatgattgaaatcgttctgccgaaacatttaaagaacgaggatgaaaaagaagtcgtcacgtctttcaaaaattttaccacatatttcaccggattctttacgaatcgtaagaatatgtattcggatggggaagaatcaaccgccattgcctaccgctgcatcaacgagaacttgccaaaacatcttgacaacgtcaaagcgtttgagaaggccatttcaaagctttctaagaacgcaatcgatgacctggatacgacttattcaggtttgtgcggtacgaacctttacgacgtattcactgttgactactttaattttttgttgccacagtccggcatcacagaatacaataaaatcattggcggatatacaacgaacgatggcacaaaagtgaagggaattaacgaatacatcaacctttacaatcaacaggtatcaaagcgcgataagatccctaacttaaagatcttgtacaagcaaattttgtctgaaagcgagaaagtaagtttcattccacccaagtttgaagatgacaacgaattattgagcgctgtctctgagttttatgcaaatgacgaaacgtttgatggcatgccccttaaaaaggctattgacgaaacgaaactgttattcggaaatcttgataatccttctttgaacggcatttatattcagaacgaccgttcagtaaccaatctgtcgaactctatgttcggctcgtggtctgtaatcgaggacctgtggaataagaattatgactcagtcaattcaaatagccgtatcaaggacattcagaaacgtgaggacaagcgtaagaaggcctacaaagccgaaaaaaaactgtcgttgtcttttcttcaagtcttgatttcaaactctgaaaacgatgagatccgtgagaaaagtattgtggactattacaaaacttcgttaatgcagcttactgataacctgagcgataaatacaatgaggccgctccgttactgaacgagaattacagtaacgagaagggacttaaaaacgacgataaatctattagtcttatcaaaaacttcttggatgccattaaggagatcgagaaatttattaaaccacttagcgagacaaatatcactggcgagaaaaatgacttattctactcgcagttcaccccgcttctggataacatcagccgtatcgacattctgtatgataaggtgcgcaattatgtaacgcaaaagccatttagtactgataaaatcaagcttaactttgggaattctcaattgctgaatggatgggatcgtaacaaagagaaggactgtggtgcggtatggttgtgcaaagatgagaaatactacctggcgattatcgataaatccaacaatagcattcttgagaatattgactttcaggactgtgatgaatcggactgctacgaaaagattatctataagctgcttccaggcccaaacaaaatgttgcctaaagtttttttttctgagaagtgcaaaaaattattatcaccctctgatgaaattctgaaaatctacaagagcgggacatttaaaaccggggacaaattcagcctggacgactgccacaaattgatcgacttctacaaggaaagttttaaaaaataccctaactggctgatttacaacttcaagttcaaaaaaactaatgagtataatgacattcgtgagttctacaacgatgtggccctgcaaggttacaatatcagcaaaatgaagatcccaacaagctttatcgacaagttagtggacgaaggcaagatttatttatttcaattatacaataaagacttttcgccgcacagtaaaggaactcccaatcttcatacgttgtacttcaaaatgctttttgatgagcgcaatttagaggatgtagtctatcgcctgaacggtgaggctgagatgttttaccgtcctgcctcaatcaaatacgacaagccaacgcatcccaaaaacacgcccattaaaaataagaatacccttaatgacaaaaagacatccacctttccttacgatctgatcaaagataaacgctacaccaagtggcaattttcgttacatttccctattacgatgaattttaaagcacccgacaaggcaatgatcaacgacgacgtacgtaatcttttaaagagttgtaataacaacttcattatcggaattgaccgtggggaacgtaaccttctgtatgtgagtgtcattgattcgaatggcgcaattatctaccaacactcattgaacattattggcaataagtttaaagaaaagacttatgagacaaactatcgtgagaaattagcgacacgcgagaaggagcgtacggagcaacgccgcaattggaaggctatcgagagtatcaaagaacttaaggagggatacatcagccaagctgttcacgtaatctgccagctggtcgtgaagtacgatgcaatcatcgtcatggaaaagctgacagacggatttaagcgtggtcgcaccaaattcgaaaaacaagtctatcaaaagttcgaaaagatgttaatcgacaaactgaattattacgttgacaaaaaactggatccggacgaggaaggggggttgctgcacgcctaccaactgaccaataaattggaaagtttcgacaagttaggtatgcaatccggcttcattttctatgtacgccctgactttaccagtaagattgatcccgttactggtttcgtgaatcttctgtatccccagtacgaaaacattgacaaagcgaaggatatgattagtcgttttgacgaaattcgctataatgcgggtgaggatttctttgagttcgatatcgattacgatgaatttccgaaaactgcctcggactaccgtaaaaaatggactatctgcacaaatggggagcgtattgaggcgtttcgtaaccctgcgaataacaatgagtggtcataccgtacaatcatcctggcggaaaaatttaaggagttgtttgacaacaactcgatcaactatcgtgactccgacgaccttaaggccgagatcctgtcccagactaaaggcaagttcttcgaggattttttcaaactgcttcgcttaaccctgcagatgcgtaactcgaatcccgagaccggtgaagaccgtatcctttctccagtcaaagataaaaacgggaacttttatgatagttccaaatacgatgaaaaaagtaagcttccatgcgatgccgatgctaacggtgcgtataacatcgcccgcaaagggctttggatcgttgagcagttcaagaaagctgacaatgtgtctacggtagagcccgtaattcataatgatcaatggctgaaatttgtacaagaaaatgatatggcgaataattaa

SEQ ID NO: 924 - DNA, 3738 bp, synthetic construct
  misc_feature 1..3738: note = Description of Artificial Sequence: Synthetic polynucleotide
  source 1..3738: mol_type = other DNA
atgcaggagcataagaaaatttctcacttgacccatcgtaattcggtccaaaaaacaattcgcatgcaattgaaccctgtcggtaagacgatggactattttcaggccaaacagatcttggaaaatgacgagaagttgaaagaaaactaccaaaagattaaagagattgcagatcgtttctatcgtaatttaaacgaagatgtgttatccaaaacgcgtctggataaactgaaagactacacagatatttattaccattgtaatacggatgctgatcgtaaacgcttagatgagtgcgcatcggaactgcgcaaagaaattgtaaaaaatttcaaaaaccgtgacgagtataacaagcttttcaataagaagatgattgagattgtattgccgaagcacctgaagaatgaagatgaaaaagaagtagtcacaagtttcaagaatttcacgacctacttcactggcttcttcaccaaccgtaagaatatgtactcagatggtgaagaatccacggcgattgcttaccgttgcatcaacgaaaatcttccaaaacacttagacaacgtaaaagcatttgaaaaagccattagtaagttatcgaaaaacgcaatcgatgatttggacaccacgtattcggggttgtgcgggaccaatctttatgatgtatttacagttgattacttcaactttctgctgccgcagagcggtattacagaatataataaaattatcggaggttatacgacaaacgatgggaccaaagtaaaagggatcaacgagtatatcaacctttataaccagcaagtctcgaagcgcgataaaattccgaatcttaaaatcttgtataaacagattctgagcgagtcggagaaagtttcatttattccgcccaagtttgaagatgacaatgagcttctttcagcagtgtctgagttctacgccaacgacgagacgttcgatggcatgcctctgaagaaagctattgatgaaacgaagttacttttcgggaatttagataaccccagtttgaatggaatttacattcagaatgatcgctctgttacgaatttaagtaatagtatgtttggttcctggtccgtcatcgaggatctgtggaacaaaaactacgactccgtcaactcaaatagtcgtatcaaggatattcaaaagcgcgaagataagcgcaaaaaagcatataaggctgaaaaaaaattatccttatcgtttttgcaagtcctgatcagcaactctgagaatgatgagatccgcgagaagagcatcgttgattactataaaacttccttaatgcaattaaccgataatctttccgacaaatacaatgaggcagcgccattattgaatgagaactacagtaacgaaaaggggctgaaaaacgacgacaaatcgatcagtttaatcaagaatttcttggatgcaatcaaagaaatcgagaaatttatcaagccgctgagtgagaccaatattacaggggagaagaacgacttgttctattctcagttcactcctctgcttgacaatatctcgcgtattgatattctttacgataaagtgcgtaattatgtaacacaaaaaccgttttcgacagataaaatcaaacttaattttggcaattcgcagcttttaaatggctgggaccgcaataaagagaaggattgcggcgcggtatggttgtgcaaggatgagaagtactatttagctattattgacaaatcgaataatagtatcttagagaatattgacttccaagattgtgatgagtcggactgttatgagaagatcatctataagcttttgcctgggccgaacaagatgttacctaaagtttttttcagcgagaagtgcaaaaagttgctttcacccagtgatgagatcttaaaaatttataaatcaggtacattcaagactggtgataaattcagtttagacgactgccataagttaatcgacttttacaaagaaagttttaagaagtacccgaactggctgatttacaactttaaattcaaaaaaactaacgaatacaacgacatccgtgagttctacaatgacgtagcattacaagggtacaatatctcaaaaatgaagattcccacaagcttcatcgataaattagtagacgagggaaaaatttacctttttcaattatataataaagatttctcaccgcattcaaaaggcacacccaacctgcacacattgtacttcaaaatgctgttcgacgaacgcaatctggaagacgttgtctaccgcttgaatggggaagcagagatgttctatcgtccagcgtcaattaaatatgataaacccacacatccaaaaaacactcctattaaaaacaaaaatacgcttaatgataaaaaaactagcaccttcccgtacgacttaattaaggacaagcgttacacaaagtggcagttttcgttgcactttccgatcaccatgaactttaaagcaccagacaaagcaatgatcaacgatgacgttcgtaacttgttgaaaagttgcaataacaatttcattattggtatcgatcgcggggagcgtaatctgctgtatgtatccgtcatcgactcaaatggcgccatcatctatcaacactcattgaatattatcggtaacaagttcaaggagaaaacttacgaaaccaattaccgcgagaagttagctactcgcgaaaaagaacgtaccgagcaacgccgcaactggaaggccattgagagcattaaagaactgaaagagggctacatttcacaggcggtacacgtgatctgccagcttgttgtcaagtacgacgccatcattgttatggaaaaattaactgacggttttaagcgcggccgcaccaagtttgagaagcaggtttaccagaaattcgaaaagatgttaatcgataaacttaactactacgtagacaaaaagttggatccagacgaagagggcggactgcttcatgcgtatcaattaacgaataagttggagtcctttgataagcttggaatgcaaagtggtttcatcttctatgtccgtccggattttaccagcaaaattgacccggttaccgggtttgttaatctgttatatccccagtatgagaatatcgataaggcgaaggatatgatttcccgctttgatgagatccgttacaatgccggagaggacttcttcgagtttgacatcgattatgatgaattccctaaaactgctagtgattatcgcaaaaagtggactatctgcaccaatggggaacgtattgaggcttttcgtaaccccgctaacaacaatgaatggagctaccgtaccatcatcttagctgaaaaattcaaggaactgttcgataacaactcgattaactatcgtgattccgacgatttgaaagctgagattctttctcagacaaaagggaagtttttcgaagatttctttaagttgctgcgccttacattacagatgcgcaatagcaaccctgaaaccggagaggatcgcattcttagtccagtgaaggataaaaacggcaacttttatgattcgagcaaatatgatgagaaatccaagttgccatgtgacgcagatgctaacggtgcttataacatcgctcgcaaaggcttatggattgtagagcaatttaaaaaagcggacaacgtttcgacagttgaaccggtgattcacaatgaccagtggcttaaattcgtgcaggaaaatgatatggcaaacaattaa

SEQ ID NO: 925 - DNA, 3738 bp, synthetic construct
  misc_feature 1..3738: note = Description of Artificial Sequence: Synthetic polynucleotide
  source 1..3738: mol_type = other DNA
atgcaggaacataaaaaaatcagtcacctgacacatcgtaactccgttcagaaaactattcgtatgcaattgaatcccgtaggtaagaccatggattactttcaggccaagcaaattttagaaaacgatgaaaagttaaaagaaaattatcagaaaatcaaagagattgctgaccgtttctaccgcaatttaaacgaggatgttctgtcaaagactcgtttagacaaacttaaagactatacagacatctattaccactgcaatacggacgcagaccgtaagcgtctggacgagtgcgcgagcgagcttcgcaaggagattgttaaaaattttaagaaccgtgacgaatataataagttgtttaataaaaaaatgattgagattgtccttcccaagcacttaaagaacgaggacgagaaggaagtagtaacatcatttaaaaatttcacgacttactttactgggttcttcactaaccgcaagaatatgtattctgatggggaggagtctactgctatcgcatatcgctgtattaacgagaatctgccaaaacatcttgacaacgtcaaagcatttgaaaaagctatctcgaagctgtccaaaaatgctattgacgacctggacactacgtactcaggtttgtgtgggacgaacctttacgacgtctttacggtggactactttaatttcttactgccgcagtcagggattacggaatacaataaaattattggaggctacacgacaaacgatggaacaaaagtgaagggaattaatgaatatatcaatctgtataatcagcaggttagtaagcgtgataaaattccaaaccttaagatcctttataaacaaattttgtcggagagcgagaaagtaagttttattcccccgaaatttgaagacgataacgaattattatctgcagtttcagagttctacgctaacgacgagacgttcgacggtatgccgttaaaaaaggccatcgacgaaactaagcttttgtttggtaacctggataatcccagtctgaatggtatctacatccagaatgatcgtagtgtcacaaatttaagtaacagtatgttcggaagctggtctgtaattgaggacttgtggaacaagaattacgactcggtgaattccaattctcgcatcaaggatattcaaaaacgcgaagataaacgtaagaaggcgtataaggctgagaagaaactttctttaagtttcctgcaggtgttgatttctaactcggaaaacgacgagatccgtgaaaagtcgattgtcgattactacaagaccagtttgatgcaattaacggataatttgtcagacaaatacaatgaggcagcaccattgcttaacgaaaactattcaaatgagaagggattgaaaaacgacgacaagtccatctcacttatcaaaaacttcctggacgccatcaaagagattgaaaaatttatcaagccattaagcgaaacaaatatcacaggcgaaaaaaacgacctgttctattcgcaattcacaccgctgctggataacatctcacgtatcgatatcctgtatgataaagttcgcaattatgtgacgcagaagccctttagcaccgataagatcaaattaaacttcggaaactcgcaattactgaacggatgggaccgcaacaaagagaaggattgtggtgcagtctggctttgcaaagatgagaagtattaccttgctatcatcgataagtctaacaatagtatcttggagaacatcgattttcaggattgcgacgaatctgactgttatgagaaaatcatctataaacttcttccgggccccaataagatgctgccgaaggtattcttctctgaaaaatgtaaaaagttactgtcacccagcgacgaaatcttgaagatttataaaagtggaacatttaagactggtgataaattttcactggacgactgtcacaaacttattgacttttacaaggaatcatttaagaagtatccaaactggcttatctataacttcaaattcaaaaagacaaacgagtataatgatattcgcgagttttacaacgacgtcgcacttcaagggtacaatatcagcaagatgaaaattccgacatcatttattgataagcttgtcgacgaaggtaagatctacctgtttcagttgtacaacaaagattttagcccacactctaagggaactccgaatttacacacgctttactttaagatgcttttcgacgagcgcaaccttgaggacgtggtttatcgtttaaacggtgaggctgaaatgttctatcgcccggcttctattaaatatgataaaccgacacatccgaaaaacactcccattaaaaataaaaatacgcttaatgataagaagacatccacattcccatacgaccttatcaaagacaagcgctatacaaaatggcagttttcccttcattttcccattaccatgaacttcaaagcgccggataaggcaatgattaacgacgacgtgcgtaatttattgaaatcatgtaataataactttattatcgggatcgaccgtggtgagcgtaatctgttgtatgtaagtgtaatcgactcgaacggggcaatcatttatcaacatagcttgaacatcatcgggaataaatttaaggaaaaaacgtatgaaacaaattatcgcgagaagttggcaacccgtgagaaagagcgcacagagcagcgccgcaactggaaagctattgagtctatcaaagaattgaaagagggctacatctcacaagcggtccacgttatctgccaactggttgtgaagtacgatgctatcatcgtcatggaaaagctgacggatgggtttaaacgcggtcgtaccaagttcgagaagcaagtctaccaaaaatttgaaaaaatgttgattgacaaacttaattattatgtagataagaagttggatcccgatgaagagggtggtctgttacacgcttatcaattaaccaataagttagaatcgttcgacaagcttggtatgcaaagtgggttcatcttctacgttcgccccgacttcacgtccaagattgatcctgtcactgggtttgtaaacttactttatccacaatacgaaaacattgataaagctaaagacatgattagtcgttttgatgaaatccgttacaatgctggtgaagatttcttcgagttcgatatcgactacgatgagtttcccaagacagccagtgactaccgcaaaaagtggaccatctgtacgaacggcgagcgtatcgaagcatttcgcaaccctgcgaataacaatgaatggagctatcgcacgatcatccttgctgagaaatttaaagaattgtttgacaacaactcaatcaactaccgtgattcagatgacctgaaggcggaaattctgtctcagacaaaagggaagtttttcgaggatttttttaagcttcttcgcctgacactgcagatgcgtaatagcaacccggagacaggggaagaccgtattctgtctcctgttaaggataaaaatggcaacttttacgacagttcaaagtacgatgaaaaaagcaagcttccatgtgatgctgatgcaaatggagcctacaacatcgcccgtaaaggattgtggattgttgagcagttcaaaaaggcggacaatgtatcgacagtagagcccgtaatccacaacgatcagtggttgaagtttgtccaagaaaacgacatggcaaacaattaa

SEQ ID NO: 926 - DNA, 3738 bp, Ruminococcus bromii
  source 1..3738: mol_type = genomic DNA
atgcaagagcataaaaaaatatcgcatcttacacacagaaattcagttcaaaaaacaattaggatgcaactgaatcctgtaggtaaaacaatggattattttcaagcaaagcaaattcttgagaatgatgaaaagcttaaagaggactatcagaaaatcaaggaaatagcagacaggttttacagaaatttgaatgaggatgtactttcaaaaaccgggttagataaattaaaagattatgctgatatttactatcactgtaatacggatgcagaccgaaaaagacttaatgaatgtgcatcggaattaaggaaagaaatcgtcaaaaattttaagaatagagatgagtataacaaactattcaataaaaagatgattgagatagttcttcccaaacatcttaaaaatgaggacgaaaaggaagttgtagcctcatttaaaaatttcacaacatactttacaggtttcttcactaacagaaaaaatatgtattcggacggagaagaatccacggcaatcgcatatagatgcattaacgaaaatttgcctaagcatcttgacaatgtcaaggtctttgaaaaagcaatttctaaactatccaaaaatgcaattgatgatttaggtgccacttattccggcttatgcggtacaaatttgtatgatgtttttacagttgattattttaactttttgcttccacaatccggaattaccgaatataacaaaatcatcggcggttacacaacaagcgacggtacaaaagttaagggtattaacgaatatataaatttgtacaatcaacaagtatccaaacgggataaaattcctaatcttaaaattttgtataaacaaattttaagtgagagtgaaaaggtatcattcataccgcctaagtttgaagatgacaacgaacttttatcggctgtttcagagttttacgcaaacgacgaaacctttgacgggatgccattaaaaaaagcaattgatgaaacaaagctattattcggcaatttagataattcctctcttaatggaatttacattcaaaatgaccgatccgtgacaaatctgtcaaacagtatgttcggttcttggtcagtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttccaattccgaaaatgatgaaatcagagaaaagtctatcgtagattactacaagacttctttaatgcaacttaccgacaatttatcagacaaatacaaagaagcagcacctctgttcagtgaaaattacgataatgaaaaaggtttgaaaaatgacgataaatctatttcattaattaaaaattttcttgatgccataaaagaaattgaaaaattcatcaagcctttgtccgaaactaatattacaggtgagaaaaatgatttgttttacagtcagttcacaccattacttgataatatcagcagaatagacatattatatgataaggtcagaaactatgttacacaaaaaccgttttcaaccgataaaatcaaacttaactttggtaattcacagctattaaacggctgggataaagacaaagaaagagagtacggagccgttttgctttgtaaagatgaaaagtattatcttgcaatcatagataaaagtaataatagtattttggaaaatattgattttcaagactgcaatgaaagcgattattatgaaaagatagtttataaacttctgactaaaataaatggaaatctcccgcgtgttttcttttcagaaaagcgcaagaaacttttgtcaccatcagacgaaatacttaaaatttataaaagcggcactttcaaaaaaggtgataagttcagccttgatgattgccataagttaattgatttctacaaagaatcattcaaaaagtacccaaattggttaatttataactttaaatttaaaaacacaaacgaatataatgatatcagcgaattttataatgatgttgcttcacagggatataatatttcaaaaatgaaaatcccgacaacatttattgacaaacttgtagatgaaggaaaaatctatcttttccaactctacaacaaagacttttcaccgcatagcaagggtactcctaatctgcatacactttattttaaaatgttgtttgatgaaagaaatcttgaagatgtggtgtacaagcttaacggtgaggcagaaatgttttatcgtcctgcaagtataaaatatgacaaaccaactcatcccaaaaacacaccgataaaaaataaaaatacactcaatgataaaaaagcaagcacttttccttatgacttaattaaagataaacgctacactaaatggcagttttcacttcacttccctattaccatgaattttaaagctccggataaggcaatgatcaatgatgatgtcagaaatctactgaaatcctgcaacaacaatttcatcataggaattgacagaggcgaaagaaacttgctttatgtcagcgtaattgacagcaacggtgctataatatatcagcactcactcaatattatcggaaacaagtttaaaggaaaaacatacgaaactaactaccgggaaaaacttgcaacaagagaaaaagatcgtacggaacagcgccgtaactggaaagcaattgagagtataaaagaactcaaagagggatatatcagtcaggctgtgcatgttatatgtcagcttgttgtcaagtacgatgcaatcatcgttatggaaaagctgactgacggattcaaacgaggtagaacaaagtttgaaaaacaggtttatcagaaatttgaaaaaatgctgattgacaaacttaattactatgttgacaaaaagcttgatcccgacgaagaaggcggtttacttcatgcctaccagcttacgaacaagcttgagagctttgataagcttggtacgcaaagcggttttattttctatgttcgtcctgattttacaagcaaaattgatcccgttaccggctttgtaaatttgttgtatcctcgatatgaaaacattgacaaagccaaagatatgatttcaagatttgacgatataagatacaatgccggcgaggacttttttgaatttgacattgattacgataagtttccaaagactgcgtctgactatcgcaaaaagtggacaatctgtactaacggcgaaaggattgaagctttcagaaatcccgcaaacaataacgaatggagttatcgtacaataattcttgcagaaaaattcaaagaattatttgataacaattctataaattatcgtgattctgacgatttgaaagctgaaattctttcacagacaaagggcaaattttttgaggatttcttcaaattattaagacttaccctacagatgcgaaacagtaaccctgaaacaggcgaggaccgtatcctttcccccgtcaaggacaaaaacggcaatttttacgacagttcaaaatatgacgaaaagagcaagcttccgtgtgatgccgatgcaaacggtgcgtacaacattgcccgcaaaggtttgtggattgttgaacaattcaaaaaagccgataatgtttcaactgtcgaaccggtaatccacaatgacaaatggctgaaatttgttcaggagaatgatatggcgaataattaa

SEQ ID NO: 927 - DNA, 3738 bp, synthetic construct
  misc_feature 1..3738: note = Description of Artificial Sequence: Synthetic polynucleotide
  source 1..3738: mol_type = other DNA
atgcaagagcataagaaaatttcccacttaacccatcgtaattccgttcaaaagactattcgcatgcaacttaaccctgtgggtaagacaatggactacttccaggctaaacaaattcttgaaaatgacgaaaagttaaaagaagactatcagaaaattaaagaaatcgctgaccgtttttaccgtaaccttaatgaagacgtattaagcaagaccggtttggataaactgaaggactatgccgacatctactatcactgtaacactgacgctgaccgtaagcgtttgaatgagtgcgcttcagaacttcgtaaagaaatcgtcaaaaatttcaaaaatcgtgacgaatataacaaactttttaataaaaagatgattgaaatcgtcttgcccaaacacctgaagaatgaggacgagaaagaagtagtagcttccttcaaaaactttacaacgtattttaccggtttctttaccaatcgtaaaaacatgtactccgacggagaggaatccacggccatcgcctaccgctgtattaatgaaaacttacctaagcatcttgacaacgtcaaagtattcgagaaggcgatctccaaactgtcgaaaaacgctattgatgatttaggcgcgacctacagcggtttatgtgggacaaacttgtatgacgtgtttacagtggactattttaactttttgcttccgcaatcggggattacggaatacaataagattatcggtggatatactacatcggacgggacgaaagttaagggtatcaatgagtacattaatctttacaatcagcaagtatccaaacgtgacaagatccctaacttaaagatcttatacaaacaaatcttgtcagaatcggaaaaagtttcattcattcctcccaaatttgaggacgacaatgaacttctttcagcagttagcgagttctatgccaacgatgagacatttgacggtatgcctttgaagaaagcgatcgacgaaacgaagttacttttcgggaatttagataattcgtccttgaacggaatttacattcaaaacgaccgcagcgtgaccaatctgtcgaactctatgttcggctcatggagcgtcattgaagatctgtggaataaaaattatgattcggtaaacagcaactcgcgcattaaagacattcaaaaacgtgaggacaaacgtaagaaggcgtataaggctgagaagaaactgtcgttatcttttttgcaggtactgattagtaattcagagaacgatgaaattcgtgaaaagtcgatcgttgattattacaaaacatcattaatgcagctgaccgataatctttccgataaatacaaggaggcagcgccgctgtttagcgaaaattacgacaacgagaagggcttaaaaaacgacgataagtctatttcattaatcaagaattttttagacgctatcaaggaaatcgaaaaattcattaagcctctttctgagacaaacatcactggagagaagaacgacttgttctacagtcaatttacccctttgttagataatattagccgtatcgatattttatacgataaggtacgcaattatgttacgcaaaagcctttctcaacggataaaatcaagctgaactttggtaatagtcagcttttaaacggctgggataaggataaggaacgcgagtatggggccgtgttgttatgtaaggacgagaaatattatttggccatcattgacaaatccaacaattccattctggaaaatatcgactttcaagattgtaacgagtctgactattatgagaagatcgtatataaactgttgacgaagatcaacggtaacttaccccgcgtatttttttcagaaaaacgcaaaaaacttctgagccccagtgatgaaattctgaagatttacaagtctgggacttttaagaagggcgataagttctcattagacgattgccacaaacttatcgacttttataaagagagttttaagaagtatccgaactggttaatttacaacttcaagtttaaaaacacaaacgagtacaatgacatctcggaattctataatgatgttgcctctcaggggtataacattagcaagatgaaaatccccacaacatttatcgataaattggttgatgaagggaaaatctacttattccagttatacaacaaggatttttctccgcattccaaggggacccctaatttgcacaccttatattttaagatgttgttcgacgaacgcaatcttgaggacgtggtttacaaattgaacggagaagccgaaatgttttaccgtccggctagcattaagtacgataagcctactcatccaaagaacaccccaattaaaaacaagaatacattgaacgataagaaggcgagtacttttccgtacgatcttattaaagataagcgctacaccaaatggcagttctcactgcatttccctattaccatgaactttaaagctcctgataaggctatgatcaacgatgacgttcgcaatttattgaaaagctgcaataataattttattattggtatcgaccgcggtgagcgtaacttgctgtatgtgtctgtgatcgactcaaatggtgctatcatctaccaacactctctgaatatcatcggaaataaattcaagggtaagacgtatgaaaccaactaccgtgaaaagttggctacccgtgaaaaggaccgcacggagcaacgccgtaattggaaagcaatcgaaagtattaaggagttgaaagaaggatatatcagtcaagcggtccatgtgatttgtcaactggtagtgaagtacgacgccatcatcgtcatggaaaagcttaccgatggtttcaaacgtggacgcaccaagtttgagaagcaagtctaccagaagtttgagaagatgttgattgataagctgaactattatgtagacaagaagcttgatccagatgaagaaggcgggcttttacacgcgtatcaactgaccaacaagttggagagcttcgacaaattgggaactcagtccggcttcattttctatgtccgccccgattttacctctaagatcgatccagtaactggctttgtgaatttactgtatccacgctatgaaaatatcgataaggctaaggacatgatttcccgcttcgatgatattcgttacaacgcgggggaggacttctttgaattcgatattgattatgataagtttccaaaaacagcatcggattatcgcaaaaagtggaccatttgtacaaacggagaacgtattgaagcctttcgtaacccggcgaacaataacgaatggagttatcgtacaattatcttggcggaaaagttcaaagaattatttgataacaactcaattaattatcgcgattcggatgaccttaaagcagagattttaagccaaacaaaagggaagttcttcgaagatttcttcaagctgcttcgccttaccttgcaaatgcgtaactcaaatccagagaccggagaggaccgcattttgtcaccagtgaaagataaaaatggaaacttttacgattcgagcaagtacgatgaaaagagtaagttaccttgtgatgcggatgcaaatggtgcatataacattgctcgcaaagggttgtggatcgtggaacaattcaaaaaagcagataatgtaagcaccgtagaaccggtgattcacaacgataagtggcttaagtttgtacaggaaaatgacatggctaataattaa

SEQ ID NO: 928 - DNA, 3738 bp, synthetic construct
  misc_feature 1..3738: note = Description of Artificial Sequence: Synthetic polynucleotide
  source 1..3738: mol_type = other DNA
atgcaagagcataagaaaatcagccacttaacacatcgcaacagcgtccaaaagacgattcgcatgcaattaaatcctgtgggcaagactatggactattttcaggccaagcagatcttagagaacgacgagaaactgaaagaagattaccagaaaattaaggaaatcgcggaccgtttttatcgtaacctgaacgaagacgtactttctaagactggtctggataagttaaaggactatgcggacatctattatcactgcaatacagatgcggatcgcaaacgcttgaacgaatgtgcgtcggaattacgtaaggagattgttaaaaatttcaaaaatcgcgatgaatataataagttgttcaacaagaaaatgatcgaaatcgtattgccaaagcatcttaaaaatgaggacgaaaaagaggtggtcgcctccttcaagaactttaccacgtacttcacaggcttctttaccaatcgcaagaacatgtatagcgacggcgaggaatcgactgccattgcttaccgttgtatcaacgagaaccttccaaagcatcttgataacgtaaaagttttcgagaaagccatcagtaaattatcgaagaatgcgatcgatgacctgggggcgacctattccggactgtgtgggactaatctgtatgatgtcttcacagtggactactttaattttttattgcctcagagcggtatcactgaatataataaaattatcgggggttacacaacgtcggacgggacaaaagtaaaagggattaatgaatatattaacctttacaatcaacaagtaagtaaacgcgataagattcccaacctgaagatcctgtacaagcagattttgagtgaatcggaaaaagttagtttcattccaccgaaattcgaagacgataatgagctgctttcagcggtatccgagttctacgcgaacgatgagacatttgatggcatgccgcttaaaaaggccatcgacgagactaaattattgttcggaaaccttgataatagctcactgaacggtatctacattcaaaatgaccgctccgtcaccaacctgtccaattcaatgttcggtagctggtcagttatcgaagacttatggaataagaactacgattctgttaattctaatagccgcatcaaagatatccagaagcgtgaagataagcgcaaaaaagcttataaggcggagaaaaagttatcattaagctttttgcaagttttgatcagtaactccgaaaacgacgaaatccgtgaaaaatcgattgtggactactataaaactagtttaatgcaactgactgataacctgtcagacaagtataaagaggcggctcctcttttctcggagaactatgacaatgaaaaaggcttgaagaacgatgacaaatcaatctctttgatcaagaattttctggacgcaatcaaggagattgagaagttcatcaaacccctgtcagagactaatattacaggagagaagaatgacttattttattcgcaatttactccattgctggacaacatctcgcgtattgacattttgtacgataaagttcgcaattatgtaacacaaaagcctttttccacggataaaatcaagcttaactttgggaactctcaattgcttaacggttgggacaaggataaggaacgcgagtacggtgccgtccttttgtgcaaggatgaaaaatactatctggccattattgataagtccaataactcgattttagaaaacatcgacttccaagattgcaatgaaagcgattactatgaaaaaatcgtctataaattattaactaaaatcaatggaaatctgccgcgcgtgttttttagtgaaaaacgcaaaaaacttctttcaccgagcgacgagattttaaagatctacaagtccgggaccttcaaaaagggcgataagttcagtttggacgattgtcacaagctgatcgatttctataaggagtcatttaagaaatatccgaattggttgatttataacttcaagttcaagaacacaaacgagtacaatgatatctcggaattttacaacgacgtggcatcgcagggttataatattagcaagatgaaaatccccaccacgtttattgataagctggtggatgagggcaagatttatcttttccaactttataacaaagacttctcacctcactctaaagggactcctaatttgcatacgctttattttaagatgttgtttgatgaacgcaaccttgaggatgtggtatacaaacttaatggagaagctgagatgttttaccgcccagcctcaattaagtatgacaagccaacccacccaaaaaacactccgattaaaaacaagaatactcttaacgacaagaaggcaagtacctttccctacgacttgatcaaggataagcgctatactaaatggcagttttcattacacttccccattaccatgaattttaaggctcctgataaagccatgattaatgacgacgttcgtaatttacttaaatcttgtaataacaactttatcattggtatcgaccgcggtgagcgtaacttattatacgtctccgtgatcgacagcaatggtgccattatttatcagcactccttaaacatcatcggcaataagttcaaaggaaaaacctatgaaacgaactatcgcgagaaactggcaactcgcgaaaaggaccgcaccgagcaacgtcgcaactggaaagcaattgaatccatcaaagagttaaaggagggatatatctcccaggctgtccacgtaatctgtcagcttgtcgtaaaatacgatgctattatcgtaatggaaaaactgaccgacggatttaagcgcggacgcaccaagtttgaaaagcaagtgtaccaaaagtttgaaaaaatgctgatcgataagttaaactattacgtagacaagaagttggacccggacgaggaaggagggttgttacacgcctatcaactgaccaacaagttggaatctttcgacaaattgggcacacaaagcggtttcatcttctacgttcgcccagatttcacctccaagatcgacccagtaacgggattcgtaaatctgctgtatccgcgttatgaaaatatcgataaggcaaaagatatgatctcacgtttcgacgatatccgttataatgctggggaagacttctttgagtttgacatcgactatgacaaatttccaaaaaccgcttccgattaccgcaagaaatggacaatttgcacgaacggtgaacgcattgaagcatttcgtaatcctgccaacaataacgagtggagctaccgtaccatcatcttagctgaaaaattcaaggagttattcgacaacaactcgattaattatcgtgactccgatgacttgaaggcggagattttgtcgcaaaccaaaggtaagttcttcgaagactttttcaagctgttgcgtttgaccttacagatgcgcaattcgaatccggaaacaggagaagaccgtatcctttctccagttaaagacaaaaatggcaacttttacgactcgagcaaatacgacgaaaaaagcaagctgccgtgtgacgccgatgcaaacggggcgtataacatcgcccgtaaaggtctgtggattgtcgagcagttcaagaaggccgacaatgtctctactgttgaaccagtcatccacaatgataaatggttaaaatttgtccaagagaacgacatggctaacaattaa

SEQ ID NO: 929 - DNA, 3738 bp, synthetic construct
  misc_feature 1..3738: note = Description of Artificial Sequence: Synthetic polynucleotide
  source 1..3738: mol_type = other DNA
atgcaggaacacaagaagatcagtcatctgacccaccgcaattcagtccaaaagaccattcgtatgcaacttaatccggtgggcaagacgatggactactttcaggcaaaacagattttggaaaatgacgagaaattaaaagaagattatcaaaaaatcaaggaaatcgcagatcgtttttatcgtaatctgaatgaagatgttttgtccaaaacaggattagacaaattaaaagactatgcggacatctactaccactgcaacaccgacgctgaccgcaagcgcttgaatgagtgtgcgtcggagttacgcaaggagatcgttaagaattttaagaatcgcgatgagtacaacaagctgtttaacaaaaaaatgatcgaaatcgtgttaccgaagcacttaaaaaacgaggacgagaaggaagtagtggcgtcatttaagaacttcactacttactttacgggcttttttaccaaccgcaaaaatatgtactccgacggggaagagtccacagcgattgcttaccgctgtattaatgagaatctgcctaaacacttagataacgttaaagtgtttgaaaaggccatctctaagctgtctaaaaacgccatcgacgacttaggtgccacatatagcggtttgtgcggtacgaatctttatgatgtctttactgtagattacttcaattttttattaccgcagtcgggtatcacagagtacaacaaaatcattggcgggtatacaacgagcgatgggactaaggtcaagggcatcaatgaatatatcaatctgtacaatcaacaggttagcaaacgtgataaaattccgaatcttaagatcttatacaaacagattttaagtgaatcagaaaaagtgagctttatcccacctaagttcgaagatgacaacgaattgttgagtgcagtttcagagttttacgctaatgatgaaacgttcgatggcatgcccctgaagaaagccattgatgagacaaaactgttattcggaaacctggacaactcttccctgaatggaatctatattcagaacgaccgctctgtcaccaatctttcgaactcgatgtttggttcttggtcagttattgaggatctttggaacaaaaactatgattccgttaactccaacagccgtattaaggacattcagaaacgtgaagacaagcgcaaaaaggcctataaagccgagaaaaagttatctttgtcgtttcttcaggtacttatttcaaactcagaaaatgatgagattcgcgagaaatctattgtagattattacaaaactagcttgatgcaactgacggataacttaagcgacaaatacaaagaagcggcgcccttattctcggagaactacgataatgagaaggggctgaaaaacgacgataagagtatttcgttaatcaaaaactttcttgatgctattaaggagatcgaaaaatttatcaaaccattatcagaaacgaatatcaccggtgagaaaaacgacttattctattctcaatttaccccgctgttagataatatttcgcgtattgacattctttatgacaaagtgcgtaactacgtgactcaaaagccgttctctacagataaaattaaattgaattttggcaacagccagttgctgaatgggtgggacaaggataaggagcgcgagtatggggcagttttattatgcaaagatgagaaatattaccttgcaattattgacaagtctaacaattcaatcttggagaacattgatttccaggattgtaacgaaagtgactactatgagaaaatcgtatacaagttacttactaagattaacgggaatttgcctcgtgtttttttctcagaaaagcgcaagaagttattatcacccagcgacgagatccttaagatttacaagtccggcaccttcaaaaaaggcgataaatttagcttagatgactgtcacaagctgatcgacttctataaagagtccttcaagaagtatcccaattggcttatctataattttaaattcaagaatactaacgaatataacgacatctctgaattttacaatgacgtagcaagccagggatataacatctcgaaaatgaaaatcccaacaacgtttattgacaagttagtggatgagggcaagatttatcttttccaactgtataataaggacttttccccccattctaaaggtactccaaaccttcatactttatacttcaaaatgttgttcgatgaacgcaatttagaagacgttgtctataagttgaatggtgaggccgagatgttttatcgtccagcgtccatcaagtatgacaagccgacacatcctaagaacaccccaatcaagaataagaacaccttaaatgataagaaagcatctaccttcccctatgatcttattaaagataagcgttatacgaaatggcagttttctctgcacttcccaatcacgatgaactttaaggccccagataaggctatgattaacgatgatgtacgcaatctgttgaaatcctgtaataataattttatcatcggtatcgatcgcggggaacgtaatttattgtatgtctcggtcattgattcgaacggggcgatcatctaccagcacagtttgaacatcatcgggaacaagtttaagggcaaaacttatgagacgaactaccgcgaaaaacttgcgacgcgtgaaaaggatcgtacagagcaacgtcgcaactggaaagctatcgagtccatcaaggaactgaaagaggggtacatcagtcaagcagttcacgtaatttgtcagctggtggtaaagtacgacgcgatcattgtgatggagaaactgacggatggtttcaaacgcggacgtactaaatttgaaaagcaggtgtaccagaaattcgagaagatgcttatcgataaacttaactactacgtagacaaaaagttagatccagacgaagaaggaggtttgcttcacgcctatcaattaactaataagttagagagtttcgataaattggggacgcagtcgggatttattttctatgtacgtccggactttacgagcaaaattgatccggtgaccggctttgtgaacctgttatacccgcgttatgaaaacattgacaaggccaaggatatgattagtcgcttcgatgatatccgctataacgcaggggaagacttctttgaatttgatattgactatgataaattcccgaaaactgccagtgactatcgtaagaagtggaccatttgtacgaatggtgaacgtatcgaagctttccgtaatccagcgaacaacaatgaatggtcttaccgcactatcatccttgccgaaaaattcaaggaattattcgataacaactcaatcaattatcgcgattccgacgaccttaaggctgaaatcttgagccagacgaaaggaaagttctttgaagacttctttaagttgttacgtttgacccttcagatgcgtaactcaaaccccgaaaccggcgaggatcgtatcttaagcccggtgaaagacaagaatggaaacttctacgactcgtcaaaatacgatgagaaaagtaaactgccctgtgatgctgacgcaaacggagcctacaacattgcccgcaagggattgtggattgttgagcaattcaaaaaagctgacaacgtcagtacggttgaacccgttattcataatgataaatggttgaaattcgtacaggaaaacgatatggcgaacaactaa

SEQ ID NO: 930 - DNA, 3738 bp, Ruminococcus bromii
  source 1..3738: mol_type = genomic DNA
atgcaagagcgtaaaaaaatatcgcatcttacacacagaaattcagttaaaaaaacaattaggatgcaactgaatcctgtaggtaaaacaatggattattttcaagcaaagcaaattcttgaaaatgatgaaaagcttaaagagaactatcagaaaatcaaggaaatagcagacaggttttacagaaatttaaatgaggatgtactttcaaaaaccgggttagataaattaaaagattatgctgaaatttactatcactgtaatacggatgcagaccgaaaaagacttaataaatgtgcatcggaattaaggaaagaaatcgtcaaaaattttaagaatagagatgagtataacaaactattcgataaaaggatgattgagatagttcttcccaagcatcttaaaaatgaggacgaaaaggaagttgtagcctcatttaaaaatttcacaacatactttacaggtttcttcactaacagaaaaaatatgtattcggacggagaagaatccacggcaatcgcatatagatgcattaacgaaaatttacctaagcatcttgacaatgtcaaggcctttgaaaaagcaatttctaaactatccaaaaacgcaattgatgatttagatgccacttattccggcttatgcggtacaaatttgtatgatgtttttacagttgattattttaactttttgcttccacaatccggaattaccgaatataacaaaatcatcggcggttacacaacaaacgacggtacaaaagttaagggtattaacgaatatataaatttgtacaatcaacaagtatccaaacgggataaaattcctaatcttcaaattttgtataaacaaattttaagtgagagtgaaaaggtatcattcataccgccaaagtttgaagatgacaacgaacttttatcggctgtttcagagttttacgcaaacgacgaaacctttgacgggatgccattaaaaaaagcaattgatgaaacaaagctattattcggcaatttagataattcctctcttaatggaatttacattcaaaatgaccgatccgtgacaaatctgtcaaacagcatgttcggttcttggtcggtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttctaattccgaaaatgatgaaatcagaaaaaagtctatcgtagattactacaagacttctttaatgcaacttaccgacaatttatcagacaaatacaacgaagcagcacctctgctcaatgagaattactctaatgaaaaaggtttgaaaaatgacgataaatctatttcattaattaaaaattttcttgatgccataaaagaaattgaaaaattcatcaagcctttgtccgaaactaatattacaggtgagaaaaatgatttgttttacagtcagttcacaccattacttgataatatcagcagaatagacatattatatgataaggtcagaaactatgttacacaaaaaccgttttcaaccgataaaatcaaacttaactttggcaattaccagctattaaacggctgggataaagacaaagaaagagagtacggagccgttttgctttgtaaagatgaaaagtattatcttgcaatcatagataaaagcaataatcgtattttggaaaatattgattttcaagactgcgatgaaagcgattgttacgaaaagataatttacaagcttctccccactccaaataaaatgcttccaaaagttttctttgcaaaaaagcacaaaaaacttttgtcaccgtcagacgaaatacttaaaatttataaaaacggcactttcaaaaaaggtgataagttcagccttgatgattgccataagttaattgatttctacaaagaatcattcaaaaagtacccaaaatggttaatttataactttaaattcaaaaaaacaaacggatataatgatatccgcgaattttataatgatgttgctttacagggatataatatttcaaaaatgaaaatccctacatcatttattgacaaacttgtagatgaaggaaaaatctatcttttccaactctacaacaaagacttttcaccgcatagcaagggtactcctaatctgcatacactttattttaaaatgttgtttgatgaaagaaatcttgaagatgtggtgtataggcttaacggtgaggcagaaatgttttatcgtcctgcaagtataaaatatgacaaaccaactcatcccaaaaacacaccgataaaaaataaaaatacactcaatgataaaagagcaagcacttttccttatgacttaattaaagataaacgctacactaaatggcagttttcacttcacttccctattaccatgaattttaaagatccggataaggcaatgatcaatgatgatgtcagaaatctgctgaaatcctgcaacaacaatttcatcataggaattgacagaggcgaaagaaacttgctttatgtcagcgtaattaacagcaacggtgctataatatatcagcactcactcaatattatcggaaacaagtttaaaggaaaaacatacgaaactaactaccgggaaaaacttgcaacaagagaaaaagatcgtacggaacagcgccgtaactggaaagcaattgagagtataaaagaactcaaagagggctatatcagtcaggctgtgcatgttatatgtcagcttgttgtcaagtacgatgcaatcatcgttatggaaaagctgactgacggattcaaacgaggcagaacaaagtttgaaaaacaggtttatcagaaatttgaaaaaatgctgattgacaaacttaattactatgttgacaaaaagcttgatcccgacgaagaaggcggtttacttcatgcctatcagcttacgaacaagcttgagagctttgataagcttggtacgcaaagcggttttattttctatgtccgtcctgattttacaagcaaaattgatcccgttaccggctttgtaaatttgttgtatcctcgatacgaaaaaattgacaaagccaaagatatgatttcaagatttgacgatataagatacaatgccggcgaggacttttttgaatttgacattgattacgataagtttccaaagactgcgtctgactatcgcaagaagtggacaatctgtactaacggcgaaaggattgaagctttcagaaatcccgcaaacaataacgaatggagttatcgtacaataattcttgcagaaaaattcaaagaattatttgataacaattctataaattatcgtgattctgacgatttgaaagctgaaattctttcacagacaaagggcaaattttttgaggatttctttaaattattaagacttaccctacagatgcgaaacagtaaccctgaaacaggcgaggaccgtattctttctcccgtcaaggacaaaaacggcaatttttacgacagttcaaaatatgatgaaaagagcaagcttccgtgtgatgccgatgcaaacggtgcgtacaacattgcccgcaaaggtttgtggattgttgaacaattcaaaaaagccgataatgtttcaactgtcgaaccggtaatccacaatgacaaatggctgaaatttgttcaggagaatgatatggcgaataattaa

SEQ ID NO: 931 - DNA, 3738 bp, synthetic construct
  misc_feature 1..3738: note = Description of Artificial Sequence: Synthetic polynucleotide
  source 1..3738: mol_type = other DNA
atgcaggagcgtaaaaagattagccatctgacgcatcgcaactctgttaagaaaacgattcgtatgcagttgaacccagtcggaaaaacaatggactactttcaagcaaagcaaattttggagaacgacgagaagcttaaagagaactaccaaaaaattaaggagatcgctgatcgcttctatcgcaatctgaacgaggacgtgctttcgaagacaggtttggacaagttgaaggattatgccgagatttactaccactgcaatacggacgcagatcgtaaacgcttaaacaagtgcgctagcgagcttcgcaaagaaatcgtcaaaaactttaaaaaccgtgatgaatataacaaactgttcgataagcgcatgattgaaatcgtgctgccgaagcatttaaaaaatgaagatgaaaaggaagttgttgcgtcattcaaaaattttacgacgtatttcacgggcttctttactaatcgcaaaaatatgtattccgatggagaggaaagtaccgctatcgcctatcgctgtatcaatgagaatttacccaagcacttggacaacgtgaaggcctttgagaaagctatttccaaactgtccaagaatgcaatcgatgaccttgacgcgacatattcagggctttgcggaaccaatttatatgatgtcttcactgtggactattttaacttcttattgcctcaatccgggatcaccgagtataataaaatcattggaggctatactaccaacgatggtacaaaggttaaaggcattaacgaatatatcaacttatacaatcagcaggtatcgaaacgtgacaaaattccgaatttacagattttatacaagcagatccttagtgaatcagagaaggtctcttttattccccctaagttcgaagacgataatgagcttttaagtgcagtttcagagttctatgccaatgacgagactttcgacgggatgcccttaaagaaagcgattgatgaaactaaattgctttttggcaatctggataactcatcccttaatgggatctacattcaaaatgatcgttccgtaaccaacttgagtaacagtatgtttggaagctggtcagtgattgaagacctttggaacaaaaactacgactctgttaattctaattctcgcattaaggatatccaaaagcgtgaagacaagcgcaagaaagcttataaagcagagaaaaagttgagccttagtttcttacaagtcctgatctccaactctgaaaatgatgaaattcgcaaaaaatctattgttgattattacaagacttcccttatgcagcttactgataatttgagcgataaatacaatgaggctgcaccgcttttaaatgaaaactatagcaatgaaaagggtttaaaaaatgacgataaatccatctcccttatcaaaaacttcttagatgcaattaaggaaattgagaaattcatcaagccattgagcgaaacgaatattacgggtgagaagaatgacttgttctattctcagtttacaccattgctggataacatttcgcgcattgacattctttatgataaggttcgtaattatgtaacacaaaaaccattttccacggataaaattaagttgaacttcggcaactatcaacttctgaacggctgggacaaggataaggagcgcgagtacggggcggtcctgctttgcaaagacgaaaagtattacctggcaatcatcgacaaatcaaataatcgtattttggagaatattgattttcaggactgcgacgaatccgactgttacgaaaagatcatttataaactgctgccgacccccaacaagatgttgccaaaggtgttttttgcgaaaaagcataagaaacttctgagcccatctgacgagattctgaagatctacaaaaatggtacatttaaaaaaggggataagttttcattggacgactgtcataagcttatcgatttttacaaagaatcatttaagaagtacccgaaatggctgatctataattttaagttcaaaaagactaacggatacaacgacattcgcgagttttacaacgatgtagcgctgcaaggctacaacattagtaaaatgaagattccgacctctttcattgataaattagtagatgagggtaaaatctatctgtttcaattatataataaggatttctctccacactcgaaggggacaccgaatttgcacacgttgtactttaagatgctttttgacgagcgcaatctggaggatgtcgtttatcgtttgaacggggaagcggaaatgttctaccgtccggccagtatcaagtatgacaaacccactcaccccaagaacacacctatcaagaataagaacactctgaacgataagcgtgcctctacttttccatatgatcttattaaggataagcgctatacgaagtggcagttcagtttgcatttcccaatcaccatgaatttcaaagatccagataaggccatgattaacgatgacgtccgcaatttattgaaatcgtgcaataataattttattatcggcatcgaccgcggggagcgtaatttactgtatgtctcagtaatcaacagtaacggcgctattatttaccagcattcattgaatatcatcggtaacaaatttaagggtaaaacatacgaaacaaactatcgcgaaaagcttgccacgcgtgaaaaggatcgcacagagcagcgtcgcaactggaaagctatcgagtccattaaagaattgaaggagggatacatttcccaagccgttcatgtcatttgtcaattagttgttaagtatgacgcgatcatcgtgatggagaaattgacggatggattcaagcgtgggcgtacgaaatttgaaaagcaagtgtaccaaaaattcgaaaaaatgttaatcgacaagttaaactactatgtagataagaaacttgatccagatgaagaggggggactgcttcatgcgtaccagttgacaaacaaactggaaagcttcgacaagttgggtactcaatccgggttcattttttatgtacgtcctgactttacaagcaagattgacccggtaaccgggtttgtaaatttgctgtaccctcgctacgagaaaattgataaagcaaaagatatgatctcgcgcttcgatgacattcgctataacgccggcgaggactttttcgaatttgatatcgattacgataagtttccaaaaacagcaagcgattatcgcaagaagtggactatttgcaccaatggagagcgtatcgaggctttccgtaatccagcaaacaataacgaatggtcttaccgtactattatcctggcggaaaagtttaaagagctttttgacaataactcaattaactaccgcgacagtgatgacttaaaggcggagattttatctcaaactaagggaaaattctttgaggacttcttcaagttattgcgtctgaccttacaaatgcgtaatagtaatcccgaaacaggagaagaccgcatcttgtctccggtcaaggataagaatggaaacttttacgatagctctaaatacgacgagaaaagtaaacttccgtgtgacgcagatgcgaatggtgcttataacattgcacgtaaaggcctttggattgtcgaacaatttaagaaggcggacaatgtatccaccgtagaacccgtgatccataatgataaatggctgaaatttgtgcaggaaaatgacatggcgaataactaa

SEQ ID NO: 932 - DNA, 3738 bp, synthetic construct
  misc_feature 1..3738: note = Description of Artificial Sequence: Synthetic polynucleotide
  source 1..3738: mol_type = other DNA
atgcaagagcgcaaaaagatctctcatttaacgcatcgcaattcggtcaaaaagacgatccgtatgcaactgaaccctgttggtaaaacgatggactactttcaagccaaacaaatccttgaaaatgacgaaaaattaaaggagaactaccagaaaatcaaagagattgcggatcgcttctatcgtaatttgaacgaggacgtcctgtccaaaacagggttggacaaacttaaagactacgcagagatttactaccactgcaacactgatgcggaccgtaagcgtttgaataaatgtgcaagtgaattgcgcaaagagatcgtaaagaactttaagaatcgcgatgagtataataagttgtttgacaagcgtatgatcgaaatcgtgcttcctaagcatttaaaaaacgaggacgaaaaagaggttgtggcgtccttcaaaaatttcactacctattttacgggcttctttacaaatcgtaaaaatatgtatagcgatggcgaagagagcaccgcaattgcctaccgctgtatcaacgaaaacttgcctaaacacctggacaacgtgaaagccttcgaaaaggctatctcaaaactgtcaaaaaatgctatcgacgatttggacgcaacctattcggggttgtgcgggactaatttatacgacgtatttaccgtcgattacttcaacttcttgttaccccaatctggaatcacagagtataataagatcatcgggggctatactactaacgatgggactaaagtcaaaggtatcaatgaatacattaacttgtacaaccagcaggtatctaaacgtgacaaaattccgaacttgcagatcctttataaacagattctttctgagagcgaaaaagtatcctttattccacctaagtttgaggacgataatgagctgttaagcgcagtctcggaattctatgcgaacgacgagacctttgacggtatgccgttgaagaaagctattgacgagacaaaactgttatttgggaacttagataattccagcctgaatggcatttatatccaaaatgaccgcagtgtcactaatctttcgaactctatgttcgggtcctggagtgtaatcgaggacttgtggaataaaaattatgactcggttaattctaattcacgcattaaggacatccaaaaacgtgaagataaacgcaaaaaagcgtacaaggccgaaaagaaactgtccctgtcgttcttacaggtccttatctccaattcggagaatgatgagattcgcaagaagtcaatcgttgactactataaaacttctttaatgcagctgaccgataatttgtctgacaaatataacgaggcagcaccgttattgaacgagaactattcgaatgagaaagggttaaaaaacgacgataaatcgatcagtctgatcaaaaattttttggatgcaattaaagaaatcgaaaagttcatcaagcccttatccgagaccaacattacaggcgaaaagaacgatctgttttactcgcaattcactccgttgttagataatatcagtcgcatcgatatcttgtacgataaagtacgtaattatgtgacacagaaaccgttctcgaccgacaagatcaagttgaattttggaaactaccaattattgaatgggtgggacaaggacaaagagcgcgaatatggagctgtcttgctgtgtaaagatgaaaaatactatcttgccattatcgacaagtccaacaaccgcattctggaaaacattgacttccaagattgtgatgagtcagactgctacgagaagatcatttataaactgttgcccactcctaacaagatgctgcctaaggtttttttcgcaaagaaacacaaaaaactgctttccccgtccgatgagatcctgaaaatctacaaaaacgggacgtttaagaaaggagacaaattctcgcttgacgattgccataagctgatcgatttctataaagagtctttcaaaaaatatcccaagtggttaatttataattttaaattcaagaagacgaatggctacaacgatattcgcgagttttataatgacgttgctttgcaaggatataacatttccaaaatgaagatcccaacatcctttatcgataaattagttgatgaagggaagatctacctgtttcaactgtacaataaagacttttcgccacactcaaaaggaactcccaacttacatacgttatatttcaaaatgttattcgatgaacgtaacttggaagatgttgtctaccgtcttaatggcgaggctgagatgttctatcgtccagccagtattaaatacgacaagccaacccaccctaaaaacacacctattaaaaacaaaaacacactgaatgataagcgcgccagtacattcccatatgatttgatcaaagacaaacgctacactaaatggcagttcagtcttcatttcccaatcactatgaatttcaaagacccagataaggccatgatcaatgatgatgtacgtaatcttttgaagtcttgcaataataacttcatcattggtattgaccgcggcgagcgcaaccttttatatgtgagcgtaattaactcaaacggcgccatcatttatcaacactcccttaacattattggcaacaagtttaaagggaaaacgtatgaaacaaattaccgtgagaaattggctacccgcgaaaaggaccgcactgaacagcgccgcaactggaaggcgatcgaaagcattaaggagttaaaggaagggtacatcagccaggcagtgcacgttatttgccaattggttgtcaaatatgatgctattatcgttatggaaaaactgaccgacgggttcaaacgtggacgcaccaagttcgagaagcaagtgtaccaaaagtttgaaaaaatgttaattgataagttaaattattatgttgataagaaattagatccagacgaagaaggcggtttacttcatgcttatcagcttacaaataagttggaaagctttgataagctgggtacgcagtccggatttattttttacgtgcgtccggacttcaccagcaagatcgatccagtcacgggtttcgttaatcttctttacccgcgctatgagaagatcgacaaggcaaaggacatgatctcacgctttgacgacattcgctacaacgccggggaagacttttttgagttcgatattgactacgacaagttccctaaaacagcctcggattatcgtaagaagtggaccatctgtactaatggtgagcgtatcgaagcattccgtaatcctgctaataacaacgaatggagctaccgcactattattttggccgaaaaattcaaggaactgtttgataacaattcgatcaattatcgcgactcagatgaccttaaagcagaaattttatcccagacaaaaggcaagtttttcgaagatttcttcaaattattgcgccttacgttgcagatgcgcaatagcaatcctgagacgggggaagaccgtatcttaagccccgtgaaggataaaaacggcaatttctacgactcgtccaaatatgatgaaaagagcaaacttccgtgtgatgctgacgctaatggggcatacaacatcgcccgtaaagggctgtggattgtggagcagttcaagaaagcagataacgttagtaccgtcgaacctgtcattcacaacgataaatggttgaaattcgtacaggagaacgatatggcgaacaattaa

SEQ ID NO: 933 - DNA, 3738 bp, synthetic construct
  misc_feature 1..3738: note = Description of Artificial Sequence: Synthetic polynucleotide
  source 1..3738: mol_type = other DNA
atgcaagagcgtaagaagatttcccacttgactcatcgtaattctgttaaaaaaaccattcgtatgcaattaaacccggtcggtaagactatggactactttcaggccaagcaaatcctggaaaacgatgaaaagttgaaggaaaactatcaaaaaattaaggaaattgctgaccgcttttatcgcaacttaaacgaggatgtgttgtcaaaaaccggccttgacaaattgaaggactacgccgaaatttattaccattgtaatacggacgccgatcgtaagcgcttaaacaaatgtgcgagcgagcttcgtaaggagattgttaaaaatttcaaaaatcgcgatgagtacaacaagcttttcgacaagcgtatgattgaaatcgtcttgcctaaacatttgaagaatgaagacgaaaaggaagtcgtagcatcctttaagaactttacgacgtactttaccggtttcttcacaaatcgtaaaaacatgtactcggatggcgaagagtcaacggccatcgcttaccgctgtattaacgaaaatctgccgaaacatttggataatgttaaagcattcgagaaggcaatctctaaattatcaaaaaacgccatcgacgatctggacgccacctacagtgggttatgcggcacgaacttatacgatgtgttcactgtagactactttaacttcttattgccccaaagcggcatcaccgaatacaacaaaattattggtggctacacgacgaacgatggtactaaggtgaaaggaatcaacgaatacatcaacttgtacaatcaacaggtttccaaacgcgataagattcccaatttacagatcttatataagcaaattctgtccgaatcagagaaggtgtcctttattccaccgaagttcgaggatgataatgagcttttatcggcggttagcgagttttatgcaaatgatgaaacttttgacggcatgccccttaaaaaagccatcgatgagacaaagttgttgtttggcaacttagacaattcttctctgaacgggatttacattcagaacgaccgttcggtgacgaatttaagcaacagtatgtttgggagttggagcgtcatcgaagacctttggaataaaaattatgatagtgtgaactctaatagtcgcattaaagatatccagaagcgtgaagataaacgcaaaaaggcctataaggctgagaaaaagctgtctctttcttttttacaggtactgatttctaactccgagaacgacgagattcgtaagaagagtatcgttgattactataagacgtcgttaatgcaacttacagataacttgtcggacaaatacaacgaagccgctcctttactgaacgaaaattattctaatgagaaaggtttaaagaacgatgataagtctatctcacttatcaagaacttccttgacgccatcaaggaaattgaaaaattcatcaaaccgttgtccgagaccaacattaccggtgaaaagaatgacctgttttacagtcaattcaccccactgcttgacaacatcagccgtattgacatcctgtacgataaggttcgtaactacgtgactcagaagcctttctccacggataaaattaagttgaacttcggaaattaccagcttttgaacggatgggataaggacaaagaacgtgagtacggtgctgttttgttatgtaaggacgaaaaatactatcttgcgattattgacaagtctaataatcgtattcttgaaaacattgactttcaagactgtgatgagagtgactgttatgaaaaaatcatttataaacttctgcccacgccaaataaaatgcttccgaaagtcttcttcgcaaaaaaacataagaagttactttcgcctagtgatgaaatcttgaaaatctataaaaacggcacctttaagaagggtgacaaatttagcttagacgattgccacaaactgatcgacttctacaaggagagtttcaaaaaatatccgaaatggctgatttacaattttaagtttaaaaaaacaaacggatataacgacattcgcgaattctataatgatgttgccctgcaggggtataatatttcaaaaatgaagattcctactagttttattgacaagttggtagatgaaggaaaaatttatctgttccaactgtacaataaagatttttcgccacattcaaaaggaaccccgaatcttcatactttgtattttaagatgttgtttgacgagcgtaaccttgaggatgtcgtttatcgtttgaacggcgaagcagagatgttttaccgcccggcgtccatcaagtatgataagccaactcacccgaagaacactccaattaaaaataagaatacattgaatgataagcgcgccagtacctttccttatgatttgatcaaggacaaacgctacacaaagtggcaattcagtcttcactttccaattacgatgaactttaaggaccctgataaggcgatgattaatgatgacgtccgtaatctgttaaaatcttgcaacaataatttcatcattggaatcgaccgtggggaacgcaatctgctgtacgtttccgttatcaatagtaacggagcaattatctaccagcatagcttgaacattatcggaaacaagttcaaaggtaaaacatacgaaactaattaccgtgaaaaactggccacacgcgaaaaggatcgcaccgagcagcgtcgcaattggaaagccatcgaatctatcaaagaactgaaggagggttatatttcgcaggctgtccatgtaatttgtcagttagtagtcaagtacgacgccatcatcgtaatggagaagcttactgacggatttaaacgtggacgcacgaaatttgaaaaacaggtatatcagaagtttgaaaaaatgctgatcgacaagcttaattattatgtggacaagaaattagatccagacgaggagggggggttattacatgcatatcagctgacgaataaactggagagttttgataagttagggactcaatcgggctttatcttttatgtacgtccagattttacttcgaagattgaccctgtgacggggtttgtaaacctgttatatccccgctacgagaaaattgataaggcaaaagatatgattagccgcttcgacgacattcgctataatgctggagaagattttttcgaatttgacatcgattatgataagttcccaaagacagcctcggattaccgtaagaagtggactatctgtactaacggggagcgtattgaagcatttcgtaaccctgcgaataacaatgaatggagttaccgcacaattattcttgctgaaaaatttaaagaattatttgacaacaattcgattaactatcgtgattccgacgatcttaaggcggaaattctttcacaaacgaaggggaagttcttcgaggatttctttaagcttcttcgcttgactttacagatgcgtaactctaaccccgaaaccggcgaagatcgtattttgagtcctgtgaaggataaaaacggtaacttttacgacagctcgaaatacgatgaaaagagtaaacttccatgtgacgcggacgcaaatggggcatacaatattgcgcgtaaggggttgtggattgtggaacagttcaaaaaggcggataacgtatccacggtagaacccgtaatccataacgataagtggttaaagttcgtgcaagaaaatgacatggctaacaactaa

SEQ ID NO: 934 - DNA, 3738 bp, Ruminococcus sp.
  source 1..3738: mol_type = genomic DNA
atgcaagagcgtaaaaaaatatcgcatcttacacacagaaattcagttctaaaaacaattgggatgcaactgaatcctgtaggtaaaacaatggattattttcaagcaaagcaaattcttgaaaatgatgaaaagcttaaagaggactatcagaaaatcaaggaaatagcagacaggttttacagaaatttaaatgaggatgtactttcaaaaaccgggttagataaattaaaagattatgctgaaatttactatcactgtaatacggatgcagaccgaaaaagacttaataaatgtgcatcggaattaaggaaagaaatcgtcaaaaattttaagaatagagatgagtataacaaactattcgataaaaggatgattgagatagttcttcccaagcatcttaaaaatgaggacgaaaaggaagttgtagcctcatttaaaaatttcacaacatactttacaggtttcttcactaacagaaaaaatatgtattcggacggagaagaatccacggcaattgcatatagatgcattaacgaaaatttgcctaagcatcttgacaatgtcaaggcctttgaaaaagcaatttctaaactatccaaaaacgcaattgatgatttagatgccacttattccggcttatgcggtacaaatttgtatgatgtttttacagttgattattttaactttttgcttccacaatccggaattaccgaatataacaaaatcatcggcggttacacaacaagcgacggtacaaaagttaagggtattaacgaatatataaatttgtacaatcaacaagtatccaaacgggataaaattcctaatcttcaaattttgtataaacaaattttaagtgagagtgaaaaggtatcattcataccgccaaagtttgaagatgacaacgaacttttatcggctgtttcagagttttacgcaaatgacgaaacctttgacgagatgccattaaaaaaagcaattgatgaaacaaagctattattcggcaatttagataattcctctcttaatggaatttacattcaaaatgaccgatccgtgacaaatctgtcaaacagtatgttcggttcttggtcagtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttccaattccgaaaataatgaaatcagagaaaagtctatcgtagattactacaagacttctttaatgcaacttaccgacaatttgtcagacaaatacaacgaagtagcacctctgctcaatgagaattactctaatgaaaaaggtttgaaaaatgacgataaatctatttcattaattaaaaattttcttgatgccataaaagaaattgaaaaattcatcaagcctttgtccgaaactaatattacaggtgagaaaaatgatttgttttacagtcagttcacaccattacttgataatatcagcagaatagacatattatatgataaggtcagaaactatgttacacaaaaaccgttttcaaccgataaaatcaagcttaactttggcaattaccagctattaaacggctgggataaagacaaagaaagagagtacggagccgttttgctttgtagggatgaaaagtattatcttgcaatcatagataaaagcaataatcgtattttggaaaatattgattttcaagactgcgatgaaagcgattgttacgaaaagataatttacaagcttctccccactccaaataaaatgcttccaaaagttttctttgcaaaaaaacacaaaaaacttttgtcaccgtcagacgaaatacttaaaattcgtaaaaacggcactttcaaaaaaggcgataagttcagccttgatgattgccataagttaattgatttctacaaagaatcattcaaaaagtacccaaattggttaatttataactttaaattcaaaaaaacaaacgaatataacgatatccgcgaattttataatgatgttgctttacagggatataatatttcaaaaatgaaaatcccgacatcatttattgacaaacttgtagatgaaggaaaaatctatcttttccaactctacaacaaagacttttcaccgcatagcaagggtactcctaatctgcatacactttattttaaaatgttgtttgatgaaagaaatcttgaagatgtggtgtacaagcttaacggtgaggcaaaaatgttttatcgtcctgcaagtataaaatatgacaaaccaactcatcccaaaaacacaccgataaaaaataaaaatacactcaatgataaaaaagcaagcacttttccttatgacttaattaaagataaacgctacactaagtggcagttttcacttcacttctctattaccatgaattttaaagctccggataaggcaatgatcaatgatgatgtcagaaatctgctgaaatcctgcaacaacaatttcatcataggaattgacagaggcgaaagaaacttgctttatgtcagcgtaattgacagcaacggtgctataatatatcagcactcactcaatattatcggaaacaagtttaaaggaaaaacatacgaaactaactaccgggaaaaacttgcaacaagagaaaaagagcgtacggaacagcgccgtaactggaaagcaattgagagtataaaagaactcaaagagggctatatcagtcaggctgtgcatgttatatgccagcttgttgtcaagtacgatgcaatcatcgttatggaaaagctgactgacggattcaaacgaggcagaacaaagtttgaaaaacaggtttatcagaaatttgaaaaaatgctgattgacaaactgaattactatgttgacaaaaagcttgatcccgatgaagaaggcggtttacttcatgcctaccagcttacgaacaagcttgagagctttgataagcttggtacgcaaagcggttttattttctatgtccgtcctgattttacaagcaaaattgatcccgttaccggctttgtaaatttgttgtatcctcgatatgaaaacattgacaaagccaaagatatgatttcaagatttgacgatataagatacaatgccggcgaggacttttttgaatttgacattgattacgataagtttccaaagactgcgtctgactatcgcaagaagtggacaatctgtactaacggcgaaaggattgaagctttcagaaatcccgcaaacaataacgaatggagttatcgtacaataattcttgcagaaaaattcaaagaattatttgataacaattctataaattatcgtgattctgacgatttgaaagctgaaattctttcacagacaaagggcaaattttttgaggatttctttaaattattaagacttaccctacagatgcgaaacagcaaccctgaaacaggcgaggaccgtattctttctcccgtcaaggacaaaaacggcaatttttacgacagttcaaaatatgatgaaaagagcaagcttccgtgtgatgccgatgcaaacggtgcgtacaacattgcccgcaaaggtttgtggattgttgaacaattcaaaaaatccgataatgtttcaactgtcgaaccggtaatccacaatgacaaatggctgaaatttgttcaggagaatgatatggcgaataattaa

SEQ ID NO: 935 - DNA, 3738 bp, synthetic construct
  misc_feature 1..3738: note = Description of Artificial Sequence: Synthetic polynucleotide
  source 1..3738: mol_type = other DNA
atgcaggaacgtaagaagatcagccacttaacacatcgtaacagtgttttgaagaccatcggcatgcagcttaatcctgtaggaaaaacaatggattatttccaagcgaagcaaatcttggaaaacgatgaaaaattgaaagaggattaccaaaaaatcaaagaaattgctgatcgtttctaccgcaatcttaacgaggacgtgctgtcaaagacaggcttggacaagttgaaagactacgccgaaatttactatcactgcaataccgacgccgatcgtaaacgtctgaataaatgtgcctctgagttgcgtaaagagattgtgaagaattttaagaatcgtgatgagtacaacaagttgttcgacaaacgcatgattgagattgtattgcccaaacatttgaaaaacgaggatgagaaagaggtggttgcctcattcaagaatttcaccacgtacttcacgggattcttcaccaatcgtaagaatatgtattccgatggagaggagtctaccgccatcgcctaccgttgtatcaacgagaaccttcctaagcatttagacaatgtaaaagcatttgaaaaggccatctctaaattgtcgaagaatgcgattgatgaccttgatgccacctattcggggctgtgcggcactaatctttatgacgtatttacggtggactatttcaactttcttttgccgcaatctggaatcacggagtataacaaaattatcggtggttacacgacttcggatggcaccaaagtcaaggggatcaacgagtacattaacctgtataaccagcaggtttctaaacgcgataagattccgaatttacaaatcctgtacaaacaaattttgtcagaatcggagaaggtatcgtttatcccgccgaaatttgaggatgataatgagctgttgtcggcagtaagtgaattttatgccaacgatgagaccttcgacgaaatgcccttgaagaaagcgatcgacgagacaaaacttctttttggaaatttggacaattcaagtctgaatggaatttacatccaaaatgatcgcagtgtcacaaacttgtcgaatagtatgtttgggagctggagcgttattgaagacctgtggaacaaaaactatgactcggtgaactctaactcacgcatcaaggacattcagaaacgcgaggacaaacgcaaaaaggcgtataaagctgagaagaagttaagcttgagttttttacaggttctgatttccaactccgaaaacaatgaaattcgcgagaagtcaatcgtggattattacaagaccagtttgatgcaattaacagacaacctgagcgacaagtacaatgaagttgctcctttattgaacgaaaattattccaacgagaaaggattaaagaatgatgataaatccatcagtttaattaagaactttctggatgctatcaaggagatcgaaaagtttattaagccactttctgagaccaacattactggagaaaaaaatgacctgttttactcgcaattcacacccttgttggacaatatcagccgtatcgatattttatatgataaggtgcgtaattatgttactcaaaagcccttttcgaccgacaaaattaaactgaactttgggaattatcaacttttgaatggatgggataaagacaaagaacgcgaatacggtgcagttctgctgtgccgtgatgagaaatattatttggcgattatcgacaaatccaacaatcgcatcttggaaaatattgacttccaagactgcgatgagagtgattgctatgagaagattatctataaattgctgcctacgccgaataagatgttaccgaaggttttcttcgcgaaaaagcataagaagcttctgtcgcccagtgacgagattttaaaaatccgcaagaatgggacattcaagaagggcgataagttctcgcttgatgactgccataagcttattgacttttataaagaatcattcaagaagtatccaaactggctgatttataattttaaattcaaaaagactaacgaatataatgatattcgtgaattctataatgacgtcgcgttgcaaggttataacattagcaagatgaaaatccccaccagcttcattgacaagttagtagatgaagggaaaatttatcttttccagctttataataaggatttttcaccgcactcgaaaggtacgcctaatctgcacacattgtattttaaaatgttattcgatgaacgtaatcttgaggatgtggtctacaagttaaatggggaggccaaaatgttctatcgcccagcgagcattaagtacgataaaccgactcatcctaaaaacaccccaattaagaacaagaacacattaaacgacaagaaagcttccacttttccttatgacttgattaaggacaaacgctatactaagtggcagttctcccttcacttctcgattaccatgaatttcaaggctcctgataaagccatgattaacgacgatgttcgtaatcttttaaagtcgtgtaataacaacttcatcatcggcattgatcgcggagaacgcaatcttttgtacgtttccgtcatcgattcgaatggtgctattatttaccagcactctcttaatattattggaaataagttcaaaggcaagacatacgagacaaattaccgcgagaaattggccacacgtgaaaaagagcgtaccgaacagcgccgtaattggaaggcgattgagagcatcaaagaattgaaggaaggctacattagtcaggcagtgcacgtgatttgtcaactggttgttaagtacgatgctattattgtaatggaaaagttaacggacggttttaaacgcgggcgtacaaagttcgagaagcaagtatatcaaaagttcgaaaaaatgttgattgacaaacttaactattatgtggacaagaaactggatccggacgaagaggggggtttgttacacgcgtaccagttgaccaacaagttagaaagcttcgataaattggggacccaatctggtttcattttctatgtccgccccgactttacctcaaagattgatcctgtaactgggtttgtgaacttattatatccgcgctatgagaacatcgataaagcaaaagacatgatttcacgctttgatgatattcgctacaacgctggggaggacttttttgaattcgatattgactacgataaattcccgaaaacagcttcagattatcgtaagaagtggacgatttgtacgaacggcgaacgtatcgaggctttccgcaacccagctaataacaatgagtggtcgtatcgtactattattttggctgagaaattcaaagaactttttgacaataactctattaactaccgcgattctgacgaccttaaagcggaaattcttagccagacaaaaggaaaattcttcgaggacttcttcaaactgctgcgtctgaccctgcaaatgcgtaattccaatcccgagactggggaagaccgtatcctgagcccagtgaaggataaaaacggtaacttctacgattcatcaaaatatgatgagaaaagtaagttaccatgcgacgcagatgctaacggtgcgtacaacattgcgcgtaaaggactttggatcgtagaacaatttaaaaagtcagataatgtgtctacggtggagcccgtaattcataatgacaaatggcttaagttcgtgcaggaaaatgacatggcgaacaattaa

SEQ ID NO: 936 - DNA, 3738 bp, synthetic construct
  misc_feature 1..3738: note = Description of Artificial Sequence: Synthetic polynucleotide
  source 1..3738: mol_type = other DNA
atgcaagagcgtaaaaaaatcagccacttgactcaccgtaatagtgtgttaaaaacaatcggaatgcagcttaatcccgtaggtaagaccatggattactttcaggcgaaacaaattttggaaaacgatgaaaaacttaaggaagattaccagaagattaaagagatcgctgatcgcttttatcgcaacttgaatgaagacgttttaagtaagacaggcctggacaaacttaaggactacgctgagatttattaccattgcaatacagacgccgatcgcaagcgtcttaataagtgcgcgtccgagcttcgtaaggagattgtgaagaacttcaagaaccgcgatgaatataataaattgtttgataaacgtatgatcgagattgtcttgccaaaacacttgaagaacgaggacgagaaagaggtggtggcatcttttaagaatttcacgacatatttcactggcttctttacaaatcgcaaaaacatgtatagtgacggtgaggagagcacggcaattgcttaccgctgtatcaacgagaatttgccaaaacacttggacaatgtcaaggcgtttgagaaagctatttcaaaactgtcgaaaaatgccatcgacgatcttgacgcaacctactcagggctttgtggaacaaacctgtatgatgtttttactgtagattacttcaacttcttgttgccacaaagtgggattaccgaatacaataagattattggcgggtataccacatcagacggcacaaaagtgaagggaatcaatgaatacatcaatctgtataaccaacaggtttctaaacgtgacaagattccgaaccttcaaatcttatataagcaaatcttatctgaatctgagaaagtttcattcatcccacctaagtttgaggacgataatgaactgctttcggccgtaagcgagttctatgcaaacgatgaaacatttgacgaaatgcctttgaagaaggccatcgacgagactaaacttctttttggcaaccttgacaactcgtcattgaatgggatctatatccaaaatgaccgttctgtgacgaatctttcgaattcgatgtttgggtcgtggtcagtcattgaggatctttggaacaaaaattacgacagtgtcaatagtaatagccgtatcaaagacatccagaaacgcgaagataaacgtaagaaggcctataaagctgagaagaagctgtcactgagttttttacaagttttgatcagtaattcggagaacaacgagatccgcgaaaagagtattgtggattactataaaacgtcgcttatgcaattaacagacaatctttcagataagtataacgaagtcgccccacttctgaatgagaattacagtaacgaaaaaggcttaaaaaacgacgacaaatctatctctcttattaagaacttcttggatgctatcaaagagattgaaaaattcattaaaccactgtcagaaacgaacattacaggagagaagaatgatctgttctatagtcaattcactccattgttagacaatattagccgtatcgatattttatatgacaaggtccgcaactatgtcacgcaaaaaccattttctactgataagattaaattgaatttcgggaactaccaattactgaacgggtgggataaggataaagagcgcgaatacggcgccgtgttactgtgccgtgatgaaaagtactacttggctatcatcgacaagtctaataaccgcattttagaaaatattgacttccaggactgtgacgaatcagattgttatgagaagattatttataaattattacctacgcctaataagatgttacctaaagtatttttcgctaaaaaacacaagaagcttctgtctccgtcagatgagatcctgaaaatccgtaagaacgggacctttaagaaaggagacaaattcagtctggacgattgccataaattgattgacttctataaagagagcttcaagaaataccccaactggttaatttataatttcaagtttaaaaaaacaaatgaatataacgacattcgtgaattctataacgatgttgcattgcaaggttacaatatctccaaaatgaagatccctacatcgttcatcgataaattggtcgacgagggaaagatttacttgttccagctgtataacaaggatttttcgcctcactctaagggcacgccgaacttgcatacgttatacttcaagatgttattcgacgagcgtaatcttgaggacgtggtgtataagttaaatggtgaggccaaaatgttttatcgcccggcatcaattaagtatgataaacctacccatcccaagaatactccgatcaagaataagaatacgctgaacgataagaaggccagcacttttccctatgatttgatcaaagataaacgttacacaaagtggcagttttctcttcatttttcgatcactatgaacttcaaggcgcccgacaaagctatgatcaatgatgacgtccgtaatttgttgaagagctgtaacaataattttatcatcggcatcgaccgcggtgaacgtaatcttttatatgtttcagttatcgacagcaacggggctattatctaccaacactcgttaaatattattggaaataagttcaaaggcaaaacctacgaaacaaattatcgcgaaaaactggcaacgcgcgagaaggaacgtacagaacagcgccgtaattggaaggccatcgagagtattaaggaattgaaagagggatacatttcgcaagcagttcacgtgatctgccagttagtagtcaaatacgatgctattatcgtcatggagaagttaactgacggattcaagcgtgggcgtaccaagttcgagaaacaagtatatcaaaagttcgaaaagatgctgattgacaagcttaactattatgtggataagaagctggaccccgacgaagagggcggtcttcttcatgcgtatcagttaacgaataaattagaatctttcgacaaacttgggacacaatctgggttcatcttttacgtccgcccggatttcacaagcaaaattgatcctgttactggattcgtaaacttgctttatccccgctatgagaatattgataaagcaaaggatatgattagtcgttttgatgatatccgctataatgcaggtgaggacttttttgaattcgatatcgactacgacaaatttcctaagactgcttccgactatcgtaagaaatggacaatttgcacaaacggtgagcgcatcgaggcttttcgcaatcccgcaaacaataacgaatggtcatatcgcacaattatcttggctgaaaagttcaaagaactgttcgataacaatagtattaactatcgtgattcagacgatcttaaggctgaaatcctgtcgcaaacgaaaggcaagttctttgaagatttcttcaagcttttgcgtctgacacttcaaatgcgcaattcaaatcctgagactggagaagatcgcattctgtccccagtcaaagataagaatgggaacttctacgactcatctaaatacgacgagaagagtaaacttccatgtgacgcagatgcgaatggtgcgtataacatcgctcgtaaaggcttgtggattgtggaacagttcaaaaaatccgataatgtttcaacagtagagccggtgatccacaatgacaaatggttgaagtttgtgcaagagaatgacatggccaataactaa

SEQ ID NO: 937 - DNA, 3738 bp, synthetic construct
  misc_feature 1..3738: note = Description of Artificial Sequence: Synthetic polynucleotide
  source 1..3738: mol_type = other DNA
atgcaagagcgtaagaaaatcagccacctgacgcatcgtaactccgtcttaaaaacaatcggtatgcagctgaaccccgtgggaaaaaccatggactacttccaggcaaaacagattcttgagaatgatgaaaaattaaaagaagactatcaaaagatcaaggaaatcgcggatcgcttctatcgcaatcttaatgaggatgtgttatcgaaaaccggacttgacaagcttaaagactatgcagagatttactatcattgtaatacggatgcagaccgcaagcgtttaaataaatgcgcatctgagcttcgcaaagaaattgtgaagaatttcaagaatcgtgatgaatataacaaattgttcgacaagcgtatgattgagattgtgttgcccaagcatctgaaaaatgaggacgagaaagaagtcgttgcatctttcaaaaactttacgacgtatttcactgggttttttaccaatcgtaagaatatgtattctgatggagaagaaagtacggccatcgcctatcgctgcattaacgagaatttacccaagcatttggacaatgttaaagcattcgaaaaggccatttctaaacttagtaaaaatgcgatcgatgatcttgacgccacatatagtgggttgtgtggtacaaacctttatgacgtgtttaccgtagattatttcaatttcttacttcctcaatctggcattacggagtataataaaattatcggcggctatacgacaagcgatggaacgaaggtaaaagggatcaatgagtacatcaatttgtataaccagcaggtgtccaaacgtgacaagatcccaaatttgcagatcttatacaaacaaattctttcagagtctgaaaaagttagttttattccccctaagtttgaggacgacaacgagctgctttccgcagtgtcggaattttacgcaaacgatgagacttttgacgagatgccattgaagaaggcgatcgacgagaccaagttgttatttggaaacttagacaattcttccttgaacggcatctacatccaaaacgatcgtagtgttaccaatttatccaactcgatgtttgggtcatggtcagtcattgaggacctttggaataagaattacgacagcgtcaatagcaactctcgcatcaaagatattcagaaacgcgaagataagcgtaaaaaggcctataaggccgaaaaaaagttaagtctttcctttctgcaggtgttaatttcgaatagtgagaataatgaaattcgcgaaaaatcaattgttgactactacaaaacatccttaatgcaacttaccgataacttatccgataaatataatgaggtggccccattacttaacgaaaattatagcaatgagaaaggattaaagaacgacgataaatccatctctcttatcaaaaacttcttagatgcaattaaagaaattgaaaagttcattaaaccattaagtgagaccaacatcacaggcgaaaagaatgacttgttctactctcaattcacgccccttttggataacattagtcgcattgacatcttgtacgacaaggttcgtaattacgttacacaaaaaccgttttcgactgacaaaattaagctgaattttggtaattaccagttacttaatggttgggataaagataaagagcgtgagtacggagccgttttgttatgccgcgatgaaaagtactaccttgccatcatcgataagtcgaacaatcgtatccttgaaaacattgacttccaggactgcgacgagtccgactgttacgaaaaaatcatttataaacttttaccaacaccaaataagatgttaccgaaagtgttctttgcgaaaaaacacaaaaaactgttatcgccgtcagatgaaatcttaaaaatccgcaagaacgggacatttaaaaagggcgacaaattcagtttagacgattgccataagcttatcgatttctataaagaatcatttaagaaataccccaactggctgatttataactttaagttcaagaaaactaatgagtacaatgacattcgcgagttctataatgacgtagcgttgcaagggtacaacatctccaagatgaaaattcctacttctttcatcgataaactggttgacgagggtaagatctacttatttcagctgtataacaaggatttctctccccattcaaaaggaacacctaacttacatacgttatacttcaaaatgcttttcgacgagcgcaacctggaggatgtagtttataaactgaatggagaggcgaagatgttctaccgtccagccagcattaagtatgataaaccgacccaccctaaaaacacccctatcaaaaataaaaatactctgaacgataaaaaggcaagtacctttccctatgacctgattaaagacaaacgctatactaaatggcagttctctctgcacttcagcatcacaatgaattttaaagcaccggacaaggcaatgatcaacgacgatgtgcgcaatttacttaagagttgtaacaacaacttcattattggaatcgaccgcggcgagcgcaaccttctgtatgtctctgtcatcgactcaaatggtgccatcatctatcagcattcgttaaatattatcggcaataagtttaaagggaagacatacgagaccaattaccgtgagaaactggcgacccgcgagaaagagcgcactgagcaacgtcgtaattggaaagctattgaatctatcaaggaacttaaagagggctatatttctcaggcagtccatgtgatttgtcagcttgtagtgaagtatgatgcgattatcgtaatggagaaattaactgatggcttcaagcgcgggcgcaccaaattcgagaagcaggtataccaaaaatttgagaaaatgttgattgataaacttaactactatgtggataagaagctggaccccgacgaggagggcggacttctgcatgcataccagttaacgaacaaattagaatcatttgataaattaggtacgcaatctggcttcattttttacgtgcgccccgatttcacttcaaaaattgatccggtcacggggttcgttaatctgctgtatcctcgttatgagaacattgacaaagctaaggatatgattagccgttttgatgacattcgttataatgcgggcgaagacttttttgaatttgatatcgattatgataaatttcccaagacggctagcgactaccgcaaaaaatggacaatctgtacaaatggcgaacgcatcgaagcatttcgcaaccctgccaataacaacgaatggagttatcgcaccatcatcctggccgaaaagttcaaagagttgtttgacaacaacagcattaattaccgtgatagtgatgacttgaaagctgagatcctgtcacagactaaagggaagtttttcgaggattttttcaagctgttacgtcttactctgcagatgcgtaattcgaacccagagaccggtgaagatcgtatcttatcacctgtaaaagataaaaatggcaatttttatgatagttcgaaatacgatgaaaagagtaaattgccttgcgatgccgatgcgaatggagcttataacatcgcacgcaagggattatggatcgtggagcaattcaagaagtcagacaatgtgagcacggttgaacccgtgatccataatgataagtggttaaaatttgttcaagaaaacgacatggctaataattaa

SEQ ID NO: 938 - DNA, 3837 bp, Ruminococcus sp.
  source 1..3837: mol_type = genomic DNA
atgtcaatcaacattaacaaattttcagatgaatgtagaaaaattgattttttcactgatttatacaacattcaaaaaactttaagattcagccttattccaataggagcaactgctgacaactttgaatttaaaggcagattatccaaagaaaaagatttgctagattctgcaaagcgtatcaaggagtatatttcaaagtaccttgcagatgaaagtgatatatgtctttcccaacccgtaaagttaaagcatcttgatgagtactatgaactttatatcactaaagacagggatgaacagaagtttaagtctgttgaagaaaagttaaggaaagaattagccgatcttttaaaagaaattttgaaacgattaaataaaaagattttatctgattatctacctgagtatcttgaagatgacgaaaaggcccttgaagatatagcaaatctttcttctttctcaacttattttaacagttattacgataattgtaagaatatgtatacagataaggaacagtcaactgcaattccttatagatgtattaatgataatttacccaaatttattgataatatgaaagcatatgaaaaggctttagaagaactaaagccaagtgaccttgaagaacttagaaataactttaagggtgtatatgacacaacagttgatgatatgtttaccttggattatttcaattgtgttctttcacagtcaggtattgattcctacaacgctattataggtaatgacaaggttaaggggattaatgagtacattaatctccataaccaaactgcagaacaaggtcataaagtccctaacctaaaacgactatataagcagattggcagtcaaaaaaagactatttcttttcttcctagtaagtttgaaagtgacaatgaactcctaaaagcagtttatgatttctataataccggtgatgctgaaaagaacttcactgcattaaaagacactataactgaatttgagaagatttttgataatctatcagaatataaccttgatggtgtgtttgtaaggaatgatatttcacttactaatttatcacaaagtatgttcaatgattggtcagtattccgtaatttatggaatgaccaatatgataaagtcaataatccggagaaagcaaaagatattgataagtataatgacaagagacataaagtctataaaaagtcagaaagtttttcaattaatcagctacaagagttaattgcaacaactcttgaagaagatattaacagtaagaaaattacagattactttagttgtgattttcatagagttacaacagaagttgaaaataaatatcaactagtaaaagacttattatctagtgattatccgaaaaataaaaacctaaaaacaagcgaagaagatgtagcacttattaaggactttttagatagtgttaaatcattagaaagttttgtgaaaatactaaccggtaccggcaaagaaagtggcaaggatgaacttttctatggtagttttacaaaatggtttgatcagttgagatatattgataagctatatgacaaggtaagaaattacattacggaaaagccttattcacttgataaaattaagctgtcttttgataatccacagttcctaggtggatggcaacatagcaaagaaactgactattcagcacaactttttatgaaagatggattgtattatcttggtgtaatggacaaagaaaccaagagagaattcaaaactcagtataatactcctgaaaatgatagtgatacaatggttaagattgagtacaatcaaatcccaaatccgggtagagttattcaaaatcttatgcttgttgatggcaagattgtaaagaaaaacggtagaaagaatgctgatggtgttaatgctgttcttgaagaactaaagaatcagtatctacctgaaaatatcaatagaattagaaaaaccgaaagttataaaaccacaagtaataactttaacaaagatgacctaaaagcatatttagagtactatattgcaagaactaaggaatattattgcaagtacaattttgtttttaagtcagctgatgagtatggaagttttaatgaatttgttgatgatgttaacaatcaagcctaccaaattaccaaagtgaaagtatctgaaaaacaattactttcattagtagaacaaggcaaactttatcttttcaaaatctacaacaaggatttttctgagtatagtaagggtaagaaaaacttacatactatgtattttcaaatgctatttgatgacagaaatcttgaaaatttagtgtacaagctacaaggtggagcagaaatgttctatagacctgcaagtatcaagaaagattcagaatttaaacatgatgcaaatgttgaaattattaagcgtacttgtgaagataaagtaaatgataaagacaatcctacagatgatgagaaagctaagtattatagcaaatttgactacgatatagtaaagaacaaacgctttactaaagatcaattttctctacatttaactttagcaatgaattgtaatcagcctgaccattattggttaaacaatgatgttagagaacttctcaagaagtcaaataaaaaccatattattggtattgatagaggtgaaagaaatcttatctatgtaactataattaatagtgatggagtaatagttgaccaaatcaacttcaatattattgaaaacagttacaatggtaaaaaatacaaaactgattatcagaaaaaacttaatcaaagggaagaagatagacaaaaggcaagaaaaacttggaaaactattgaaacaattaaggaactgaaagacggttacattagtcaggttgtacatcaaatttgtaaacttattgttcaatatgatgcaattgttgtgatggaaaaccttaatggtggtttcaaaagaggtagaacaaaagttgaaaaacaagtttatcaaaagtttgaaactatgcttattaataagctgaattattatgttgataaaggtactgactataaagaatgtggtggacttttaaaggcatatcagcttacaaataagtttgaaacatttgaaagaatcggtaaacaaagtggtattatcttttatgttgacccatatctgacaagtaagattgacccggtaacaggttttgcaaatctgctttatcctaagtatgaaacaataccaaaaactcacaacttcattagcaatattgatgatattcgatataaccaaagtgaagattactttgagtttgatattgattatgataagttcccgcaaggtagttacaattatcgtaagaagtggacaatctgttcttatggcaacagaattaagtattacaaagattcaagaaataaaacagctagtgtagttgttgatattactgaaaagttcaaggaaacttttactaacgcaggtattgactttgttaatgataatattaaggaaaagttattgttagttaatagtaaggaactcctaaagtcatttatggatactcttaaactgactgttcagttgagaaattctgaaattaatagtgatgttgattacattatctcaccgataaaggatagaaacggtaacttctattatagcgaaaactacaaaaagtctaataatgaagtaccgtcacaaccacaagacggtgatgcaaatggtgcatataacattgcacgaaaaggattgatgattattaacaaactaaaaaaagccgatgatgtaaccaataatgagttgttgaaaatcagcaaaaaggaatggctggaatttgctcaaaaaggtgatttaggtgagtga

SEQ ID NO: 939 - DNA, 3837 bp, synthetic construct
  misc_feature 1..3837: note = Description of Artificial Sequence: Synthetic polynucleotide
  source 1..3837: mol_type = other DNA
atgagtatcaatatcaataagttcagcgatgagtgtcgcaaaattgacttttttacagacctttacaacattcaaaagacactgcgttttagcttgatcccaatcggtgctacagcggacaactttgaatttaaggggcgcctttctaaagagaaggacctgcttgactcagccaagcgtatcaaggagtacattagcaagtacctggctgacgaatcggacatctgcttatctcaaccggtcaaattaaagcatttggacgagtactatgagttatatattaccaaagaccgcgacgaacagaaattcaagagtgttgaagagaaattacgcaaggagcttgccgatttgctgaaagagattttaaaacgcctgaacaaaaaaatcttaagtgattacttacccgagtacttagaggacgatgaaaaagcgcttgaagacattgctaatttgtcttctttttcgacttactttaattcatattatgataattgtaaaaatatgtacacagacaaagaacaaagtaccgcgattccttaccgctgtattaatgacaatttaccaaaatttatcgataatatgaaggcgtatgaaaaagctttagaggagctgaagcctagtgatttggaagaattgcgcaataactttaaaggcgtgtacgacaccaccgtcgatgacatgttcaccttggactatttcaattgtgtcctgtcccagagtggtattgactcttacaatgcgattattggcaatgacaaagttaaaggtatcaacgaatatatcaatctgcataaccagacagcagaacagggccataaagtcccaaacctgaaacgtctgtacaaacagatcggaagccaaaaaaaaaccatctcgttccttccatcaaaattcgaatcagataacgagcttcttaaggctgtctacgatttttataacacaggagacgctgaaaaaaacttcacggccctgaaggatacgattacagaattcgaaaagatttttgataacctgagcgaatataaccttgatggcgtcttcgtgcgcaatgacatttcgctgacaaatctgtcccagtctatgttcaatgattggtctgttttccgtaacctgtggaatgatcagtatgacaaagtaaataaccctgagaaagcaaaggatatcgacaaatacaatgacaaacgtcataaggtttataaaaaatccgaatccttctccattaatcagttgcaagaacttatcgcaacaacattggaggaagacatcaactcgaaaaagatcactgattacttctcgtgtgacttccatcgcgtaacgactgaagtggaaaacaagtaccaactggtaaaagacctgttgtcttcagattatcccaagaacaagaatttaaagacaagtgaagaagatgtggcacttattaaagatttcttagattctgtcaagtcccttgaatccttcgtaaaaattctgacaggcacgggtaaggagagtggaaaagacgagttgttttacggtagtttcacgaaatggtttgatcagcttcgctatatcgataagttatacgataaggtacgcaactacatcacggagaaaccatattcccttgataagattaagttatcctttgacaatccccaattcttaggtggatggcagcactctaaggagacagattattccgctcaactgttcatgaaagacggtctgtactatttaggtgtcatggacaaagaaacaaagcgtgaattcaagacacaatacaacacacctgaaaatgattccgatacaatggtaaagatcgagtacaaccaaattcctaaccctggtcgcgttatccagaatttaatgttagttgatggcaagattgttaagaaaaatggtcgcaaaaatgccgatggcgttaatgctgtacttgaagagttgaaaaaccaatatttacctgagaacattaatcgtatccgtaagacggaatcttataagacaacttcgaataatttcaataaggacgaccttaaagcgtacttagaatattacatcgctcgcacaaaagagtactactgtaaatacaacttcgtgttcaagagtgcggatgaatacggcagtttcaatgagtttgtggacgatgtcaacaatcaggcgtatcagattactaaagtaaaagtgtctgaaaaacaacttttgtcgcttgttgaacagggcaaattatacctgtttaaaatctataataaggattttagcgaatattcgaaaggaaagaaaaatctgcacaccatgtacttccaaatgctgtttgatgaccgcaatcttgagaatttagtttataagttgcagggtggggctgagatgttttaccgtccagcgtcaattaaaaaagactcggagtttaagcatgacgcaaatgtcgaaattattaaacgcacgtgcgaggacaaggtaaacgataaggataacccaacggacgacgagaaagcaaaatattattctaagttcgattacgacattgtgaaaaataagcgcttcaccaaggaccaattctcacttcatcttacattggcaatgaattgcaatcagcccgatcattattggttaaataacgatgttcgcgagttattgaagaagagtaataagaaccacattatcggtatcgaccgtggcgagcgcaatttgatttatgtaactatcatcaacagtgacggtgtgattgtcgatcagattaactttaatattatcgagaactcttataacggcaagaaatacaagacagactatcaaaaaaagctgaatcaacgcgaagaagatcgtcaaaaggcacgtaagacctggaagaccatcgagacaatcaaagagttaaaggatggctacatttcacaggtcgtgcaccaaatttgtaaattgattgtgcagtatgatgcaattgtagtcatggaaaatttgaatggtgggttcaaacgcggtcgcaccaaggtcgaaaagcaagtctatcagaaattcgagaccatgcttatcaataaacttaattattacgttgacaagggaacagactacaaagaatgcggcggattattaaaagcgtaccaattgacaaacaaatttgagacgttcgaacgtatcggcaagcaaagcggtattatcttttacgtggacccttacctgacttctaagatcgatcctgtaacgggcttcgcgaacctgttatacccgaaatatgagacgatccccaaaactcacaacttcatctccaatatcgacgacattcgttataatcaaagcgaagactactttgagttcgatattgattacgacaaatttccacagggctcctataactatcgcaagaaatggactatttgtagttatggaaatcgcattaaatattacaaagatagtcgtaataaaactgcgagcgtcgtagtagatatcacagagaagttcaaggagacttttactaatgccgggattgacttcgtcaatgacaacatcaaggaaaagttattgctggtaaactcgaaagaattgctgaaaagttttatggatacgttgaagttgacagtacagttgcgcaactcagaaatcaatagtgatgtggactatattatttcccccattaaagaccgcaatggaaatttctactatagtgaaaattacaaaaagtctaacaatgaggtaccctcccagcctcaggacggcgatgctaacggcgcatacaatattgcgcgtaaaggcctgatgatcattaacaagcttaagaaggcggatgatgttacaaacaatgaattactgaagatctccaagaaggagtggttggaatttgctcagaaaggagaccttggtgagtga

SEQ ID NO: 940 - DNA, 3837 bp, synthetic construct
  misc_feature 1..3837: note = Description of Artificial Sequence: Synthetic polynucleotide
  source 1..3837: mol_type = other DNA
atgtctattaacattaacaaattcagcgacgaatgtcgtaaaatcgatttttttacagacctttacaacatccaaaagacgttgcgtttttcgttgatccctatcggggcaacagcggacaactttgaattcaaagggcgtctgagcaaagaaaaggatcttttggattcagcaaaacgtatcaaagaatacattagtaaatatttagcggacgaatcggacatttgtttatctcagccggttaaattgaagcacttagacgagtactatgaactgtacatcaccaaggatcgtgatgagcaaaaattcaaatctgtggaggaaaagcttcgcaaggaactggcggaccttttaaaggaaattttaaaacgcttgaacaagaagatcctttctgactacttaccggaatacttggaggacgacgaaaaagctctggaggacattgccaaccttagttcttttagtacgtactttaactcgtattacgataattgcaaaaacatgtacaccgacaaagagcagtcgactgcgatcccgtatcgttgtattaatgacaaccttccaaagttcattgataacatgaaggcttatgaaaaggctttggaggaattaaaaccatccgaccttgaggaattacgcaacaacttcaagggagtatacgatacgacagttgacgacatgttcactttagattacttcaactgtgtactgagccagtcgggcattgactcctataacgctatcattgggaacgacaaggtaaaaggcatcaacgaatacatcaaccttcataatcaaacggcggagcaaggtcacaaagtcccaaatttgaaacgtctttacaaacaaatcggctcgcagaagaagacgattagcttcctgccctcgaagttcgaatccgacaatgaattgttaaaggccgtatatgacttctacaacactggcgatgccgaaaaaaactttactgccttaaaagataccattactgagtttgaaaagatctttgataatctgtcagagtacaaccttgatggggtgttcgtacgcaacgacatttcacttactaatctgtcccagagcatgtttaacgactggagtgtatttcgcaatttatggaatgatcaatatgacaaagtcaacaacccggagaaagcaaaagacattgataaatacaatgacaaacgccacaaagtttataaaaaaagtgagtcgtttagtatcaatcagttgcaggagttaattgcaactacccttgaggaagatatcaatagcaaaaaaatcacggattacttttcatgcgatttccaccgcgtcaccaccgaagtcgagaataaataccaattggtaaaggatctgttatccagcgattacccaaaaaataaaaacttgaaaacgtccgaggaagatgtcgcgttgatcaaggactttcttgattccgtgaagtctttagagtcattcgtaaaaattttaaccggaacgggaaaggaaagcggtaaagatgaattattctatggttcctttactaaatggttcgaccaactgcgttatatcgacaaattgtatgataaggtccgtaactatattacagagaaaccatactcccttgacaaaattaaattaagttttgataatccccagtttctggggggatggcagcattccaaagagactgactactccgctcagttgttcatgaaggatgggttatattatcttggtgtcatggacaaagaaacaaaacgcgagtttaaaactcagtataatacacccgagaacgactcagacactatggttaaaatcgaatataatcaaattcctaatccagggcgcgtcattcaaaatttgatgttggtggatggtaagattgtaaagaaaaatggccgtaagaacgcggacggcgtaaatgcggtgcttgaagaactgaagaatcaatatttgcctgagaatatcaatcgcattcgtaaaaccgaatcgtataagaccacatctaataatttcaacaaagacgaccttaaggcgtacctggagtactatatcgcacgcacgaaagaatattactgtaaatataacttcgtctttaaaagcgccgacgaatacggcagttttaatgaattcgtggatgatgtcaataatcaggcttaccagatcactaaggtgaaagtgtctgagaaacaactgttatctcttgtcgagcagggtaaactgtatttattcaaaatttataacaaggacttctcggagtacagcaaaggaaaaaagaatcttcacactatgtatttccaaatgttattcgacgatcgtaacttggaaaatcttgtttacaagcttcaggggggagcagaaatgttctaccgcccagcctccattaaaaaagactcagaattcaagcatgacgccaatgttgaaatcatcaagcgtacatgcgaggataaggtaaatgacaaagacaatccaacagatgacgagaaagccaagtactatagcaagttcgactatgacatcgtgaagaataagcgctttactaaagatcagttcagtcttcaccttacccttgcaatgaactgtaatcagccagatcactattggctgaataacgatgtgcgtgagttgcttaaaaaaagtaacaaaaatcacattattgggatcgatcgtggggaacgtaacctgatctacgtgactattattaattcggatggggtaattgtagatcagattaattttaacatcatcgagaactcgtacaatggaaagaaatataaaacggactaccaaaagaagttgaatcagcgcgaagaagaccgtcaaaaggcccgtaagacctggaaaacgatcgagacgatcaaggaattaaaagacggctacattagtcaggttgtccatcagatttgtaaattaattgtccaatatgatgccatcgtcgtgatggagaacttaaacggagggttcaagcgcggccgcacgaaagtggaaaagcaagtgtatcaaaagttcgagaccatgttgattaacaaacttaactattatgttgataaaggaaccgactacaaagagtgtggtggcctgttaaaagcgtatcaacttactaacaagtttgagacctttgagcgcatcggcaaacagagcggcatcatcttttatgtagatccataccttacatctaaaatcgatccggtgacgggttttgcaaatttgctgtaccctaagtatgaaactatcccaaaaacacataacttcatctccaatatcgatgacatccgttacaaccagtcagaagattacttcgagttcgatattgactacgacaagtttcctcaaggctcgtataactaccgtaagaaatggactatctgttcgtacggaaatcgcatcaagtactataaggacagtcgcaataaaacagcctcggtagtcgtcgacatcaccgaaaaatttaaggagaccttcaccaacgcgggcatcgatttcgttaacgataatatcaaggaaaagcttcttcttgtcaactccaaggagcttttaaagtcgtttatggatacccttaaactgacagttcagcttcgcaattcggagatcaacagcgatgtggactatattattagtccgatcaaggatcgcaacggaaacttctactatagtgaaaattacaagaagtcaaacaacgaggtgcccagccaaccacaagatggagacgctaatggcgcctacaacattgcacgcaaaggcctgatgatcatcaacaaattaaaaaaggcggacgacgtgaccaataacgagctgttgaaaatttcaaaaaaggaatggttggagtttgcgcagaaaggtgatttaggtgagtga

SEQ ID NO: 941 - DNA, 3837 bp, synthetic construct
  misc_feature 1..3837: note = Description of Artificial Sequence: Synthetic polynucleotide
  source 1..3837: mol_type = other DNA
atgtcgatcaatatcaataaattttctgatgagtgccgtaagatcgactttttcactgatctttataatatccaaaaaactttgcgctttagtctgattccgattggcgctacagctgataattttgagtttaaaggtcgcttatctaaggagaaggatttattggattcggcgaagcgtattaaggaatatatctctaagtatctggctgacgaatccgatatttgtttaagtcagccagtgaaacttaagcacctggacgagtattatgagttgtatattaccaaagatcgtgacgagcagaagtttaagtccgttgaggagaaactgcgtaaggaattagccgaccttttgaaagagatcctgaagcgtctgaacaaaaagattcttagcgactatttaccggagtaccttgaggatgatgagaaggccttagaagacatcgctaacttgtcctcattctctacgtactttaatagttattatgacaactgcaaaaatatgtatacagataaagagcaatcgaccgccatcccttaccgttgcatcaacgataacttaccgaagttcatcgacaatatgaaagcctatgaaaaagccttagaggagctgaagccaagcgatttggaggagcttcgtaacaattttaagggagtatacgacacgaccgtggacgacatgttcactctggactactttaactgcgtgttgagtcagtctggcatcgacagctataacgcaatcattggcaatgacaaagttaagggcatcaatgaatatattaacttgcacaatcaaactgctgagcaaggacacaaagtgcccaatcttaaacgtctttacaaacaaatcggttcacaaaagaaaacgatttcttttcttccttccaaatttgaatcggataatgaactgttgaaggccgtgtatgatttttataatacgggtgacgccgaaaaaaactttactgcattaaaagacactatcacagaatttgagaagatctttgataacttgtccgagtataacttggacggcgtattcgtacgcaacgacatttccctgacaaatctttctcaatccatgttcaacgattggtcagtatttcgtaacttgtggaacgaccagtacgataaggtgaacaatcccgaaaaagcaaaagacatcgacaagtataatgataaacgtcataaagtgtataagaaatccgagagcttctccatcaaccaactgcaagaattgattgcgaccacgctggaggaggatattaactcgaagaagatcaccgattacttctcctgtgattttcaccgtgtgacgactgaagtcgagaataaatatcagcttgtgaaagaccttttaagttcagattacccaaaaaacaaaaatctgaagaccagtgaggaagacgtggccttaatcaaagatttcttagatagcgtaaagtctctggagagcttcgtcaaaatcctgacgggcacaggcaaagaaagtgggaaggacgaacttttctacgggagttttacaaaatggttcgatcaattacgttacatcgataagctgtacgacaaagtccgtaactatatcaccgagaaaccatactcattggacaagattaaattgtccttcgacaacccacagtttttgggtggttggcagcattcaaaggagactgattatagtgcgcagctttttatgaaggatggcctttattaccttggcgtgatggataaggagaccaagcgtgagtttaagactcaatacaacactcccgagaatgactcagatacgatggtcaaaatcgaatataatcagatcccaaaccccggccgtgtaatccagaatcttatgctggtggacggtaaaatcgtcaaaaaaaacgggcgtaagaatgccgatggagtgaatgccgtacttgaagagcttaagaaccagtaccttccagaaaacatcaaccgtatccgtaagaccgagtcctacaagacaacgagcaacaacttcaacaaggatgatcttaaagcttacttggagtattatattgcccgcacgaaagagtactattgcaagtacaacttcgtatttaaatcggcagacgaatacggcagtttcaacgaatttgtggacgatgtgaataatcaggcataccagattacaaaagttaaggtttcagaaaagcaacttctgagtttggtggagcaaggaaaattgtacctgtttaagatctacaacaaggactttagtgaatattcgaagggaaagaaaaacttgcatacgatgtattttcaaatgttgtttgatgaccgtaaccttgaaaacttagtgtacaaactgcaaggaggtgcggagatgttttaccgccctgcttcaatcaaaaaagacagcgagttcaaacacgacgcaaatgtagagatcatcaagcgcacgtgcgaagacaaggtaaacgataaagataatcccacagacgacgaaaaggccaagtactattcgaaattcgattatgacatcgttaagaacaaacgttttacaaaggatcaattcagtttacacttaacgttagcaatgaattgtaatcaaccggaccattactggctgaacaacgacgtacgcgagttgctgaagaagtctaataaaaatcatatcattggtattgaccgtggtgagcgcaatctgatctatgtaacgatcattaatagtgacggagtgatcgtagatcaaattaatttcaacatcattgagaattcatacaatggtaaaaaatataagacggactatcagaaaaaactgaaccaacgcgaggaagatcgtcaaaaagcccgtaagacgtggaaaacaatcgaaaccattaaggaattgaaagacgggtatatctcccaagtagttcaccaaatctgcaagcttatcgtccaatatgatgcgatcgttgtcatggaaaatttgaatggtgggtttaagcgcggccgcaccaaagtggagaagcaagtttatcaaaaattcgaaacaatgttgatcaataagttgaattattatgtcgataagggcaccgattacaaagagtgcggtgggttattaaaggcataccagctgaccaacaaatttgagacttttgagcgcatcgggaaacaatctggcatcatcttctacgttgatccgtatttaacttccaaaattgatcccgtgaccggctttgcgaacctgctttatcctaagtatgagacgatccccaagacacataatttcatcagcaacatcgatgacattcgttacaatcaatcagaagactactttgaattcgatatcgactatgataaattcccacagggttcttataactatcgtaagaaatggaccatctgttcatatggcaatcgtattaaatattataaagattctcgcaacaaaaccgcctctgtcgtagtcgatatcaccgagaagttcaaggaaactttcacgaacgctggaattgacttcgtcaacgacaacatcaaagaaaaacttctgttagtaaattcaaaagagttactgaaaagctttatggacacgcttaagttgaccgttcagttgcgtaattctgaaattaactcggacgttgactatatcatcagtccaatcaaagaccgtaacggaaacttctactactcagaaaactacaagaaaagcaataacgaggtgccctcgcaaccacaggatggcgatgctaacggcgcttataatattgcgcgtaaggggttgatgattatcaataagctgaagaaggcagatgatgtgacaaacaatgagcttcttaaaattagcaaaaaggaatggttggagtttgcccagaaaggagatcttggcgagtga

SEQ ID NO: 942 - DNA, 4689 bp, Leptospira ilyithenensis
  source 1..4689: mol_type = genomic DNA
atgaaagcaacatccatttgggacaactttactcgtaaatattccgtatctaaaacacttcggtttgaattgaggccagtggggaagacggaagagaatattgtgaaaaaggaaattattgatgcagagtggatcagcggaaagaatattccgaagggaactgatgctgaccgggcaagagattataaaattgttaaaaaattactgaatcaactccatattttatttattaatcaggcattatcctctgaaaatgtgaaagagttcgaaaaagaggataaaaagagtaaaacattcgttgcatggagtgatttacttgcaactcattttgacaactggattcaatatactcgtgataaaagtaattccactgtcttaaaatccttagagaaatcgaaaaaggacctatattcaaaacttgggaaactactcaactctaaagccaatgcctggaaggcagagtttataagttatcacaaaattaaaagcccggacaatataaagattagattgtctgcaagcaatgttcagatactatttggaaatacatcggatcccattcaattattgaaatatcagattgagttagataatataaaatttctaaaggatgatggatccgaatatactacaaaagaattagccgacttgctttctacgtttgaaaaatttggaacttatttttctggattcaatcaaaatcgagcaaatgtctatgacattgatggcgagatttctacctcaattgcatatagactttttaatcaaaatatagaattctttttccaaaacattaaaagatgggagcaattcactagttctattggtcataaagaagcaaaggaaaatctaaaattagtccaatgggatattcaatcaaaactcaaagaattagatatggaaatagttcaaccaagatttaatcttaaatttgaaaaattactcactccacaatcgttcatttatctactcaaccaagaaggcattgatgcattcaacactgtccttggtggaattcccgcagaagtgaaagctgagaaaaagcagggagtaaacgaactaatcaatttaactcgacagaaattaaatgaagacaagagaaaattcccttctcttcagattatgtataaacagatcatgagtgaaagaaaaacaaacttcattgatcagtatgaagatgatgtagaaatgttaaaggaaatccaagaatttagtaatgactggaatgaaaaaaagaaaaggcattcagcatcaagtaaagagatcaaagaaagtgcaattgcctatattcaaagagagtttcatgaaacattcgattcattggaagaacgcgctaccgtaaaagaagatttctatctgagtgaaaagtcaattcagaatctatcaattgatatttttggaggttataataccatccacaatctttggtatacagaagtagagggaatgttaaaatccggcgaacgaccactcactagagtagaaaaagaaaaactcaaaaaacaagagtatatttctttcgctcaaatcgaaaggcttatctcaaagcattcacaacaatatctagattcaacgccaaaagaggccaatgatagatctcttttcaaagagaagtggaaaaaaacgtttaaaaatggatttaaggtatcagaatatacaaatttaaaattgaatgagctaatatctgaaggtgaaacatttcaaaagattgatcaagaaactgggaaagaaaccacaattaaaattcctggtttatttgaaagttacgaaaatgcaatattagtcgaatccataaaaaatcaatcgcttggaacaaataaaaaagagtctgttccgtccattaaagaatatcttgattcctgtttgagattatctaaattcattgaatcatttttagtcaattcaaaggatctaaaagaagatcaatccttagatggttgcagcgactttcagaatacgcttacacaatggctcaatgaggaatttgatgttttcattttgtacaacaaggtaagaaaccatgtaaccaaaaaaccaggaaatactgataagataaaaataaacttcgacaacgctacgttattagatggttgggatgtagataaggaagcagcaaacttcggatttctacttaagaaggcggataactactatctaggaatagctgattccagctttaatcaagacttaaagtattttaacgaaggagagagattggatgaaattgaaaaaaacagaaagaatcttgaaaaagaagagagtaaaaacatttcgaaaatcgaccaggaaaaagtaaaaaaatataaggaagtaattgatgacttaaaagcaatttccaatcttaataaaggacgttattcgaaagcattttataaacaaagcaaatttactactttaataccaaaatgcaccacacagctaaatgaagtgatagagcattttaagaaattcgacactgattatagaattgaaaataaaaaatttgcaaaaccttttataatcacaaaagaagtctttttacttaataatacagtttatgatacagccaccaaaaagtttactcttaaaataggtgaggatgaagatacaaaaggattaaaaaaatttcaaatcggatattatcgtgcgacagatgacaaaaaaggatatgagtccgccttacgaaactggataactttttgtattgagtttacgaaaagttataaaagttgccttaactataattactcatccttaaaatctgtgtccgaatacaagtcactagatgaattctataaagatttaaatggaatagggtatacgattgatttcgtagacatttccgaagaatacataaataaaaaaataaatgaaggaaaactatatcttttccaaatctacaataaagatttttcagaaaaatcaaaaggaaaagaaaacctccatacgacctattggaagttgttatttgattcgaaaaaccttgaagatgtagttataaaactaaacggacaagcggaagtgttctttcgaccagcttctattcatgaaaaagaaaaaatcactcatttcaaaaatcaggaaatacaaaataagaatcctaatgctgtgaaaaaaactagtaaatttgaatatgatataatcaaagacaatcgatttacgaaaaacaaattcttgtttcattgccctatcacattgaattttaaggcagatggaaatccgtatgtaaataacgaagttcaagaaaatatagcaaaaaatccaaatgtgaacatcattggaatcgaccgtggagaaaaacatctcctttattttacagttatcaatcagcaagggcaaatactcgatgctggtagtctgaattccattaaatccgaatataaagataaaaaccaacaatcagtctcctttgagacaccgtaccacaaaatcttagataaaaaagagtcagaaagaaaagaggcaagggaatcttggcaagaaattgaaaatatcaaagaactaaaagcaggatatttgtcacacgtagtacaccaattatcaaatttgatcgttaaatacaatgcgatagtggtactcgaagatttaaataagggatttaaaagaggtagatttaaagttgaaaaacaagtttatcaaaaatttgaaaagtcgttgatagaaaagttgaattatctggttttcaaagaccgcaaagaatcaaatgaacctgggcatcatttgaatgcttatcaattaacaaataaattcttaagctttgaaagattaggtaaacagtcaggagtccttttttatgcaactgcgagttatacatcaaaagtggatcctgtcactggctttatgcaaaatatttatgatccatatcataaagaaaaaacaagggaattctataagaattttaccaagattgtttataatggaaactactttgaatttaattatgatttgaactcagtaaagcctgattctgaagaaaaaagatatcggacaaattggacagtatgcagttgtgtgattcgatctgagtatgattcaaattccaaaactcaaaaaacttataatgtaaatgatcaacttgtaaaactattcgaggatgccaaaataaaaattgagaacggaaacgatctaaaatccaccattctagaacaagatgataaatttatccgagacctccatttttactttattgcaatacagaagatgagagttgttgattcaaaaatagaaaaaggagaagattcgaatgattatattcaatcgcccgtttatcctttctattgttccaaagaaattcaaccgaacaaaaaaggattctatgaacttccaagcaatggagattccaatggagcctacaatatcgcgcggaaaggaattgtaattttggataagattcgtttgagagttcaaatcgaaaaattgtttgaagatggaacgaaaattgattggcaaaaacttccaaaccttatttcaaaagtaaaagataaaaaacttctcatgactgtctttgaagaatgggcagaactgacacatcaaggggaagttcagcaaggtgacttgcttgggaaaaagatgagtaagaaaggagaacaatttgctgaatttataaaaggactcaatgttacaaaggaagattgggaaatttatactcaaaatgaaaaagtagtacaaaagcagataaagacttggaaattgtttagcaattctacctaa

SEQ ID NO: 943 - DNA, 4689 bp, synthetic construct
  misc_feature 1..4689: note = Description of Artificial Sequence: Synthetic polynucleotide
  source 1..4689: mol_type = other DNA
atgaaggcgactagtatttgggataactttactcgtaagtatagtgtatctaaaacgcttcgctttgagcttcgccctgttggtaagactgaggaaaatattgtaaaaaaggagattattgacgccgagtggattagcgggaagaacattccaaagggtactgatgctgaccgcgcgcgcgactataaaattgtcaaaaaattgttaaaccagctgcacattcttttcatcaatcaggccttgtcttcggagaatgtaaaggaattcgagaaggaggacaaaaagtctaaaacctttgtggcttggtcggatctgttggcgacgcacttcgataactggatccaatacacacgtgataagtctaatagcactgtcttaaaatctttagagaagtcaaaaaaagatttatactcgaagttaggaaaattactgaactcaaaggctaacgcttggaaagcagagtttattagctaccataagattaaaagccccgacaatatcaagattcgcttatctgcgagcaacgttcaaatcctgtttgggaatacgagtgatccaatccaactgttaaaataccaaatcgaactggataatattaagttcctgaaagatgatggctcggaatatacaacgaaagaactggctgatctgttgagtacctttgaaaaattcgggacgtacttttccggctttaaccagaatcgtgcaaacgtgtatgatattgatggtgaaatttcaacgagtatcgcttatcgtctttttaaccagaatatcgaattttttttccaaaacattaaacgttgggagcagtttacaagttcaatcgggcacaaagaggccaaggaaaacctgaagcttgtgcagtgggatattcaatccaagctgaaagagcttgacatggagatcgtgcaacctcgctttaaccttaagtttgaaaagcttctgacaccacaaagtttcatttacttgctgaaccaagagggaattgatgcgtttaacaccgtcttaggcggaatcccagctgaggtgaaagctgagaaaaaacaaggcgtaaacgaactgatcaaccttacacgccaaaaattaaacgaggacaaacgcaaatttccctctctgcaaatcatgtataaacagattatgagtgagcgtaaaacgaatttcattgaccagtatgaagatgacgtggaaatgttaaaggagatccaagagttctcaaatgattggaacgaaaagaagaagcgtcattctgcatctagtaaggagatcaaggagagtgcaattgcgtacattcagcgcgaattccatgagacttttgacagtttggaagagcgcgccacagtcaaagaggacttctatttgagcgaaaagtctattcagaatttgtcgatcgacatcttcggcggctacaacacaattcacaatttatggtacactgaagtagaggggatgctgaagtcaggtgaacgtcctttaactcgtgtagaaaaagaaaaactgaagaagcaggaatatatctcatttgctcaaatcgagcgccttatttccaagcacagtcagcagtatcttgactcaacacctaaagaggctaacgaccgttcattgtttaaggaaaaatggaaaaaaactttcaagaatggcttcaaggtatcagaatacacaaatttgaagcttaacgaactgatctcggagggagaaacattccagaaaattgatcaagaaacaggcaaggaaacaacaatcaagatccccggtttgttcgagtcttatgagaatgccatcttggttgaatctatcaagaatcaaagtttaggaaccaataagaaagagagcgtgccgtcgatcaaggaatatttagatagctgccttcgcttatctaagttcatcgagagcttcttggtgaacagcaaggatttaaaagaggatcaaagcctggatggatgcagcgactttcaaaacactttgactcaatggcttaatgaagagtttgacgtttttatcctgtataataaggtccgtaaccatgtaaccaagaaaccgggcaatacagacaaaattaaaattaacttcgataacgccacgctgcttgacggttgggacgtagataaagaagccgcaaactttggtttcttactgaaaaaggcagataactactatttagggatcgctgattcatcgtttaaccaggatcttaagtattttaacgagggagaacgcttggatgaaatcgaaaaaaaccgcaaaaatttggagaaagaagaatccaaaaatatcagcaaaattgaccaggagaaagttaaaaaatacaaggaggtcattgacgatttgaaggccatttcgaaccttaataaaggacgttactctaaagctttttataaacagtcaaaatttacaacgcttattcccaagtgtacaacccaattgaacgaagtcattgaacacttcaaaaaattcgatacggactatcgtattgagaataaaaagtttgctaaaccctttattattacgaaagaggtttttttgttaaataatacggtgtacgatactgctacgaaaaagttcacgcttaaaatcggggaagacgaggatacgaaaggactgaaaaagtttcagattggctactaccgcgcaacagacgacaagaagggttatgaaagcgccctgcgtaactggattaccttttgtatcgagtttacaaagagctacaagtcgtgtttaaactacaactattcgtcgcttaaatcagtaagtgaatacaagtcgcttgatgaattttacaaggatttaaacggtattgggtatactattgactttgtcgatatctctgaggagtatatcaataagaagatcaacgagggtaagttatatttattccaaatctataacaaagatttcagcgaaaagtcaaaagggaaagagaatctgcacacaacgtattggaaactgttattcgactcaaagaacttggaggatgttgttatcaagttgaacgggcaagctgaagtctttttccgtcccgccagtatccacgaaaaggaaaagatcacgcacttcaaaaaccaggaaattcaaaataagaaccccaacgccgtgaaaaaaacgtccaaattcgagtacgatattattaaagacaaccgcttcacaaaaaacaagttcttgttccattgcccaatcactctgaattttaaagccgacgggaacccgtacgtgaataacgaggtacaggaaaacattgccaagaatcctaatgtaaacattatcgggatcgaccgtggggagaagcatttgttgtactttacggtaatcaaccaacaaggacagatcctggatgcgggcagcctgaactcaatcaagtccgaatataaagataagaaccaacagtccgtctctttcgaaacgccgtaccacaaaatcctggacaaaaaggagagtgagcgtaaggaggcccgcgagagctggcaagagattgaaaacatcaaggaactgaaagccggataccttagccatgtcgttcatcaactgagcaacttgatcgtaaagtacaatgcaatcgtagttctggaggatttaaataagggctttaagcgcgggcgcttcaaagtagagaagcaagtctaccaaaagttcgagaagtctttgattgagaagttaaattatttagtctttaaggaccgtaaggaatcaaatgagcctggtcaccacttgaacgcttaccaactgacaaacaaattcttgtcttttgagcgccttgggaaacaaagtggtgtacttttctacgctacagcgtcatacacctcaaaggtcgaccccgtaacgggatttatgcaaaatatttatgatccatatcataaggaaaaaactcgcgagttctataaaaacttcacgaagatcgtctataacgggaactattttgagtttaattatgacttgaactcagtcaagcctgacagcgaggagaagcgttaccgcacaaattggacggtatgctcctgtgtgattcgttcggaatacgactctaattcaaaaacgcaaaagacatataatgttaatgaccagctggttaaattatttgaagacgccaaaatcaaaattgagaacggtaatgatttaaagtcgacaatcttagagcaggatgataagtttatccgcgatttacacttctacttcatcgcaatccagaagatgcgtgtcgttgatagtaaaatcgaaaaaggcgaagattcaaatgattatattcagagcccggtttaccccttctactgctccaaagaaatccagccgaacaaaaagggcttctacgagttaccatcaaacggtgattctaacggagcgtacaacattgctcgtaaaggcatcgtaattttagacaagatccgcctgcgcgtacagattgaaaagttattcgaggacgggacgaaaattgattggcagaagcttcctaatttaatctctaaggttaaggacaaaaagcttttgatgacggtgttcgaagagtgggcggagcttacacatcaaggagaagttcagcaaggtgaccttcttggtaagaaaatgtcgaaaaagggagaacagttcgcggagtttattaaaggattgaatgtaacgaaggaagactgggaaatctacacgcaaaacgagaaggtagtacagaagcaaattaagacttggaagcttttttcaaactcgacctaa

SEQ ID NO: 944 - DNA, 4689 bp, synthetic construct
  misc_feature 1..4689: note = Description of Artificial Sequence: Synthetic polynucleotide
  source 1..4689: mol_type = other DNA
atgaaggcgacgtcgatttgggacaacttcacacgtaaatacagcgtctctaagacacttcgtttcgagctgcgcccagttggaaaaactgaagagaatatcgttaaaaaagaaattatcgacgcggagtggatctcaggcaaaaatattccaaaaggtactgatgcagatcgcgcccgtgactataaaatcgttaaaaagttattaaatcaactgcatatcttattcatcaaccaggctttatcgagtgaaaacgttaaggaatttgagaaagaggataagaaaagtaagacgtttgtcgcatggtctgatttgttagctacgcatttcgataattggatccagtatacgcgcgataagtcaaactcgactgtattgaaatcattggagaaatcgaaaaaggatttgtacagtaagttgggtaaactgttgaatagtaaagcaaacgcgtggaaagctgaatttattagttatcataaaattaagtctccagacaatattaaaattcgtctttctgcatccaatgtgcagatcctgtttggtaacaccagtgatccaattcagttgcttaagtatcagatcgaacttgacaacattaagtttctgaaagatgatggaagtgaatacaccacaaaagagcttgcagacttactgtcgacattcgagaagttcgggacgtatttttcaggatttaaccaaaaccgtgccaacgtctatgacattgatggggaaatctccactagtatcgcctatcgcctgtttaaccagaatattgagttcttttttcaaaatatcaagcgttgggagcagttcacatccagtatcggtcataaagaggcgaaggagaacctgaaactggtacagtgggatatccaaagcaaattaaaggagcttgacatggaaatcgtccagccccgtttcaatttaaagtttgagaagttgctgactccgcaaagtttcatctatttattgaatcaagagggaattgatgcttttaacacagtccttggcgggattccagcagaagtgaaagcggaaaaaaaacagggggtcaatgaattaattaacttgacccgtcagaagcttaatgaagataaacgcaagttcccttcattacaaattatgtacaaacagattatgtcagaacgcaaaacgaatttcatcgaccaatatgaagatgacgtcgagatgttgaaagagatccaggagttcagtaacgattggaacgaaaaaaaaaagcgtcacagtgcatcatccaaagagattaaggaatccgcgattgcttatattcaacgcgagttccacgaaacattcgactccttagaagagcgcgcaacagtcaaagaggatttttatcttagcgaaaaatcaattcaaaacttaagtatcgacatcttcggagggtataatactattcacaatttgtggtacactgaggtggaggggatgttaaaatcgggagagcgccctttgactcgtgtggagaaggagaagttaaagaaacaagaatatattagcttcgctcagattgagcgtttaatcagtaagcacagtcaacaatatctggacagtaccccgaaagaggccaatgatcgttcgctttttaaagagaagtggaaaaagacatttaaaaatgggtttaaggtcagcgaatataccaatcttaagctgaacgagttaatctccgaaggggagacattccagaagatcgaccaagagacgggcaaagaaaccacaattaagatcccgggcttatttgagtcatatgaaaacgcgattttagtcgagtcaattaagaatcagtctctgggcacgaataaaaaggagagtgtacccagtattaaggaatacttagactcgtgcctgcgcttaagtaagtttattgagtcgttcttggtcaactcgaaggatctgaaggaagatcaaagtttggatggctgttctgactttcagaacacattaacacaatggcttaatgaggaatttgatgtcttcattctgtataacaaggtacgtaaccatgtgaccaagaagccgggtaatacagataaaattaagatcaactttgataacgccacgctgctggacgggtgggacgtggacaaagaggcggccaacttcggatttttgttaaagaaggcggacaattactacttggggattgctgattcctcgtttaaccaggatttaaaatactttaacgaaggagaacgcctggacgaaattgaaaagaaccgtaagaacctggaaaaagaagaatctaagaatattagtaagatcgaccaggagaaggtgaagaagtataaggaagttattgatgacttgaaagctatttccaatttgaacaaaggacgttactcgaaagccttttacaagcagagcaagtttactacgttaattccgaaatgcacaacccagcttaatgaagtcattgagcactttaaaaagttcgatacagattatcgcattgaaaataagaagtttgctaagccattcattattactaaagaggtttttcttctgaataacactgtgtatgacaccgcaacaaaaaaatttaccttaaagattggggaagatgaagacacaaaggggttgaagaaattccagattggatactatcgcgcaaccgatgataagaaggggtacgaatcggcgctgcgtaactggatcacattctgcatcgaattcactaagagttacaaatcgtgccttaattacaactacagtagtcttaagagtgtttcagagtacaaatctttagacgaattctacaaagacttgaatgggatcggttacactattgacttcgttgatatctcagaagagtacattaataaaaaaatcaacgagggcaagctgtatctttttcagatctacaataaagatttttccgaaaaaagcaaagggaaggaaaatttacatacgacttactggaagctgttatttgactcgaagaatttggaggatgttgttatcaaacttaacggacaagcagaagtcttcttccgtccggcgtcaattcacgagaaagaaaagattacgcactttaagaatcaggaaatccaaaacaagaatccaaacgccgtgaagaagaccagtaagtttgaatatgatattattaaggacaatcgctttacaaagaataaatttctttttcactgtccgattactctgaactttaaagcagacggcaacccttatgtgaacaacgaggttcaagagaatatcgctaaaaatcccaatgtgaacatcatcgggatcgaccgtggcgagaaacaccttctttactttactgtaatcaatcaacaaggccaaattttagacgctggctcattaaatagtattaaaagtgagtataaggacaaaaaccagcagtcggtttcctttgagactccgtatcacaaaattttagacaaaaaggaatccgagcgtaaggaagctcgcgaatcttggcaggagattgaaaatattaaggagttaaaggcaggatatttgtcgcatgtcgtccaccaattgtcaaatctgatcgttaagtacaacgcgattgtcgttttagaagacctgaataagggcttcaaacgtggacgttttaaggtggaaaaacaggtatatcaaaagttcgagaaatcattaatcgaaaagctgaattatttagtctttaaggaccgcaaggagagcaacgagccgggtcatcatttaaacgcttatcagctgacgaataagttcctgtcgtttgagcgtttagggaagcaaagcggcgtattgttttatgctactgcttcatatacatctaaagtagatcccgtaaccggattcatgcagaatatttacgacccatatcacaaggagaaaactcgcgaattttacaagaattttactaaaattgtgtacaacggcaactatttcgagttcaattacgatcttaacagtgttaaaccggattcagaagagaaacgttatcgcactaattggacggtttgcagttgcgttattcgtagtgaatacgactcaaatagtaagacacagaaaacgtataacgtgaacgatcaattggtcaaactgtttgaggacgcgaaaattaagatcgagaatggtaatgaccttaagtctacaatccttgaacaggatgacaagtttatccgcgatttacatttctattttatcgccatccaaaaaatgcgcgtggttgacagcaagattgagaaaggtgaagacagcaatgattacatccagtcgccggtctatccattttattgctccaaggaaatccaacccaataaaaagggcttctatgaacttccctcgaatggagactccaatggagcttacaacatcgcacgcaaggggattgtgattcttgacaagattcgtttgcgcgtacaaattgaaaaattgttcgaagatggtacgaaaattgactggcagaagcttcctaacttaatttcgaaggtcaaggataagaagttacttatgaccgtcttcgaggagtgggccgagcttacccaccagggagaagtacaacagggagacttgttgggaaaaaaaatgtcgaaaaaaggcgaacagttcgcagaatttatcaaggggttgaatgttactaaagaagactgggaaatttacactcagaacgagaaagtcgttcagaaacaaattaagacatggaagcttttctctaactcgacctaa

SEQ ID NO: 945 - DNA, 4689 bp, synthetic construct
  misc_feature 1..4689: note = Description of Artificial Sequence: Synthetic polynucleotide
  source 1..4689: mol_type = other DNA
atgaaggcaacgtccatctgggacaatttcacccgtaaatattcggtgtctaagactctgcgtttcgagctgcgcccggttggcaagacggaggaaaacattgtaaagaaggaaattattgacgccgaatggatctctgggaaaaatatcccgaagggtaccgacgccgaccgcgctcgtgattataaaattgtgaagaagttgttgaatcaattgcatattttgttcatcaatcaggcactgtcgagcgagaacgtaaaggaattcgaaaaggaagataaaaaatcaaagacttttgttgcgtggtcagatctgttggcgacccatttcgacaattggattcaatatacccgtgataaatctaactccaccgtattaaaatccctggaaaagtctaagaaggatctttactccaagttgggaaagcttttgaattctaaggctaatgcgtggaaagcagaattcatttcgtatcataagattaaaagccctgataacattaaaattcgtctgtcggcgtcaaatgtacagattttgtttggaaataccagcgacccaattcagttattaaagtaccagatcgagttagacaatatcaaatttttgaaggacgacggcagcgaatacactactaaagagttagcggacctgctgtcaactttcgaaaagttcggtacttacttttccggttttaatcaaaaccgtgctaacgtttatgacattgacggagagatcagtacctcgatcgcttatcgtctgttcaaccagaatatcgagttttttttccagaacattaagcgctgggaacagttcacatcctcaattggccacaaggaagctaaggagaaccttaaattggtccaatgggacatccagtctaagttgaaagaattagatatggaaatcgtacagcctcgcttcaatttgaaattcgagaagcttttgactccacagtcgttcatttacttattgaatcaggaaggcatcgacgcatttaatacggtcttggggggcatccccgctgaggtgaaagcggagaagaagcagggggtaaacgaattgattaatttaacccgtcagaaattgaacgaggacaaacgcaaatttccctccttacaaattatgtacaagcaaattatgtctgaacgtaagacaaattttatcgatcagtatgaggatgatgtcgaaatgctgaaggagatccaagagtttagcaacgattggaatgagaaaaaaaagcgccattccgcttcgagcaaagaaattaaggaaagtgccattgcctacatccaacgcgaattccatgaaacttttgactcattagaagaacgcgctacagtaaaagaagacttttatctgagtgaaaaaagtatccaaaatttatctattgacatcttcggcggctataacacgatccacaatttgtggtatactgaagtcgaaggcatgcttaagagtggtgagcgcccgttgacacgtgtagaaaaggaaaaattgaaaaagcaagaatacatcagtttcgcccaaattgagcgtttaatctcgaaacattcacagcagtatttagattccactcctaaggaggcaaatgatcgttcccttttcaaggagaaatggaaaaagacattcaagaacggattcaaggtctctgaatacaccaaccttaaattgaacgaactgatctcggagggcgaaacctttcaaaagatcgatcaggaaaccggtaaggagaccacaattaagattcccgggttgttcgagtcatacgagaacgctattctggttgagtctatcaagaatcaaagcttgggcacgaacaaaaaggaatcggtaccatcgattaaagaatatctggacagttgtttgcgtttatcgaagttcattgagtctttccttgtgaattcaaaggacttgaaagaagatcaatcgttggacggatgttctgactttcagaatacgttaacccagtggttaaatgaggaatttgatgtttttatcttatataataaggtccgtaatcatgttaccaaaaagcctggaaataccgataagatcaaaatcaatttcgataacgccacattgcttgacggttgggatgtagataaagaggcggcaaacttcgggttcctgcttaaaaaggcggacaactattaccttggcattgccgacagtagctttaatcaggatttgaagtatttcaacgaaggtgaacgcctggatgaaatcgagaagaaccgtaaaaatttggagaaggaggaaagcaagaatatctcaaaaattgaccaagaaaaagttaagaagtataaggaagtaattgatgaccttaaggcaatcagcaaccttaacaaagggcgctactcgaaggctttttacaagcagtccaagtttaccactctgatcccgaaatgtaccactcaattaaacgaagtcattgagcatttcaaaaaatttgacaccgactatcgcattgagaataaaaagttcgcgaaaccattcatcattaccaaggaggtttttttattaaataacaccgtgtacgataccgcaacgaaaaaatttacgttgaaaatcggggaagatgaggacacgaagggcttaaaaaaattccagattgggtattaccgcgccactgatgacaaaaaggggtacgagtcggccttgcgcaactggattacattttgtatcgagttcacaaaaagttataaatcatgccttaactacaattattcatcgttaaaaagcgtctccgagtacaaatctcttgacgagttctataaggaccttaatgggatcgggtatacaatcgactttgtagacatttcagaggaatacatcaataagaaaatcaatgagggcaagttatacctttttcaaatctataacaaagactttagtgagaaatcaaaaggcaaagaaaatctgcataccacgtattggaaacttcttttcgacagcaagaacttggaagacgttgtaatcaaacttaacgggcaggccgaagtatttttccgtccagcatcgattcatgagaaagaaaaaatcactcattttaaaaaccaagaaattcagaacaagaatccgaatgccgtgaaaaaaacttccaagttcgaatacgatatcatcaaggacaaccgttttactaaaaataaattcttgttccattgtcctattacgctgaactttaaggctgacggtaatccttatgtaaataacgaagtacaagaaaacatcgctaagaatcccaatgtaaacattatcggtattgatcgcggagagaagcatctgctttacttcacagtcatcaaccagcaaggccagatcttagacgcaggttcgttgaacagcatcaagtccgagtacaaggataaaaatcagcaaagtgtctcgtttgaaacgccctatcacaagattcttgacaagaaggaatcagaacgtaaggaagcccgcgagtcgtggcaagaaattgagaatatcaaggagcttaaagcgggatatctgtcgcacgtcgttcatcaactttctaatttaatcgtaaagtacaacgcgattgtagtgttagaagacctgaacaagggatttaaacgcggacgcttcaaagtagaaaagcaagtctatcaaaaatttgaaaagtccctgattgaaaaattgaattatttagtattcaaggaccgcaaggagtctaatgagcctggtcaccaccttaacgcttatcaattgactaacaaattcttatcattcgaacgtttaggtaagcaatcaggcgtgttgttttatgctaccgctagttacacatcaaaggttgatccggtgaccggcttcatgcaaaatatctatgacccgtatcacaaagaaaaaactcgcgagttctacaagaacttcacgaagatcgtttacaatggaaactatttcgaatttaattatgacttaaactctgtaaaacccgactccgaagaaaagcgttatcgtacgaattggaccgtttgctcctgcgttattcgctcagaatatgatagcaatagtaaaacacagaagacatataatgtaaatgaccagcttgtgaaactgtttgaagatgctaaaatcaaaatcgaaaatggtaacgacttgaagtctacgattcttgagcaagacgacaagtttattcgcgatctgcacttttattttattgctatccagaaaatgcgcgtggtggacagtaaaatcgagaaaggggaagactcaaacgactatattcagtcaccagtctatcccttctactgcagcaaagagatccaaccaaacaagaagggtttctacgaattaccaagtaacggtgactctaacggcgcatacaacatcgcacgcaaagggattgttattctggataaaattcgcctgcgtgtacaaattgaaaagttatttgaagatgggaccaaaatcgactggcaaaagttgcctaaccttatcagcaaagtgaaagacaagaaactgttaatgaccgttttcgaagaatgggcggagttaactcatcagggagaggtacaacaaggagacttgctgggcaagaaaatgagcaaaaaaggggaacagtttgcagagtttattaagggccttaacgttacgaaggaagattgggaaatttacacccagaatgaaaaggttgtgcaaaagcagatcaagacttggaaattgttttctaactccacttaa

SEQ ID NO: 946 - DNA, 2616 bp, Prevotella sp.
  source 1..2616: mol_type = genomic DNA
attaaggctattaatgaatattataagcagttgggagcttattgtcgtgaagaaggaaaagaaaaagatgatttctttaagcgtattgatggtgcttattgtgctatatcacatcttttctttggggaacatggcgaaatagcccagtcagactcagatgttgagcttatccaaaagttgctcgaagcctataaggggttacaacgctttatcaagcctttattaggtcatggtgatgaagctgataaagacaatgagtttgatgcaaaacttcgtaaagtatgggatgaactcgacatcattacaccgctttatgataaagtacgcaattggctctctcgtaagatatataaccctgagaaaataaagctatgttttgagaataatggcaagttgttatctggatgggttgacagcagaactaaatccgataatggtactcaatatggagggtatatctttagaaagaagaatgaaattggtgaatacgatttctatttgggtatttctgctgatacaaaactgtttcgtcgtgatgctgccatcagttatgatgatggcatgtacgagagattagattattatcagctgaaatcaaaaactttactcggaaatagttatgttggagattatggactggattcgatgaatttgctttctgcatttaaaaatgctgcagttaagttccaatttgaaaaggaagtggttcctaaagataaagagaatgtgccaaaatatctcaagcgcctaaaactggattatgcaggattttatcaaattttgatgaatgatgataaggttgttgatgcttacaagattatgaagcagcatattcttgcgacattgacttcttcgattcgtgtacctgcggcaatagagttagctactcaaaaagaattgggtattgacgaattgattgatgaaataatgaatttaccgtccaagtcattcggctatttccctattgtcactgcagcaatagaagaagctaacaagagagagaataaacctttgtttctttttaagatgagtaacaaggatctttcttatgcagcaacagcttctaaagggttaagaaaaggtcgaggaacagagaatcttcattcaatgtatctcaaagctcttctggggatgacacagagtgtttttgatatcggaagtggaatggtattctttcgtcaccaaactaaaggtttggcagaaacaacggcaagacataaagctaatgagtttgttgctaataagaacaagcttaatgacaagaaaaagagtatttttggctatgagatagtgaagaataaacgttttacggtagataagtacctttttaagttgtctatgaatttgaattattcgcaaccaaataacaataaaattgatgtaaattctaaagttcgtgaaataattagtaatggaggtataaagaatattattggcatagatcgtggtgaacgtaatttactttatctgtctttaatagatctgaagggaaatattgtcatgcagaagtctctcaatattctcaaggatgatcataatgcaaaggaaactgattataaaggtttgctgacagaacgagaaggagaaaataaagaagctcgccgcaattggaagaagatagcgaatatcaaagatttaaaacgaggttatttaagtcaggtagtacatatcattagtaaaatgatggtagaatacaatgcaattgttgtacttgaagatttaaatccaggttttatcagaggcagacaaaaaatcgagcgtaacgtatatgaacaattcgaaagaatgctaattgacaagttgaatttttatgttgacaagcataaaggtgccaatgaaacgggaggtttgttgcatgcacttcagcttacttctgaatttaaaaatttcaagaaaagtgagcatcagaatgggtgtcttttctatattcctgcatggaatactagcaaaatagatcctgcaacaggttttgtcaatctctttaatacgaaatatacgaatgcagttgaggcgcaggagttctttagtaaatttgacgagattcgttacaacgaggagaaagattggtttgagtttgaatttgattacgataaattcactcagaaggcgcatggtacacgtactaagtggacgctctgtacttatggtatgcgtttgcgttcatttaaaaattctgcaaaacaatataattgggattcagaggtagtagcgcttaccgaagaattcaaaagaatacttggagaagcaggtattgatattcatgagaatctaaaagatgcaatctgtaatttggaaggtaaaagccagaagtatctcgaacctttgatgcagtttatgaaattgctgctacaattgcgtaatagtaaggctggtactgacgaagattatatcctttctccagttgctgatgagaatggaatattctacgatagccgttcttgtggtgatcaacttccggagaatgcggatgctaatggtgcttacaacatcgctcgcaagggactgatgctgattgagcaaatcaagaatgcagaggatttgaataacgtcaagtttgatatatccaataaggcttggctcaattttgcacaacaaaagccatataagaatggatga

SEQ ID NO: 947 - DNA, 2616 bp, synthetic construct
  misc_feature 1..2616: note = Description of Artificial Sequence: Synthetic polynucleotide
  source 1..2616: mol_type = other DNA
attaaggcgattaacgaatattacaagcagttaggagcatattgccgtgaagaagggaaagagaaggacgatttctttaaacgcattgacggcgcgtattgtgctatctcccatttgtttttcggtgaacatggagagatcgcccagtcagactcggacgtggagctgatccaaaagcttctggaagcttacaaaggtctgcaacgcttcattaaaccattgttaggtcacggagacgaagcagacaaagacaatgagtttgatgccaagctgcgtaaggtctgggacgaattagacattatcaccccgttgtatgacaaggtacgtaactggctttcgcgcaaaatttacaaccccgaaaaaatcaaattgtgctttgagaataatgggaaactgcttagtggttgggtagacagccgcacgaaatctgataacggcacacagtacgggggatacattttccgcaagaagaatgaaattggcgagtatgacttttatctgggaatttcagcagatacgaagcttttccgccgtgatgccgcgatttcatacgatgatggaatgtacgagcgtttagattactaccaactgaagagcaagacattactgggcaactcgtacgtcggggattacgggctggacagcatgaacttgttgtccgcttttaagaacgcagcggtgaagttccagttcgaaaaggaggttgtaccgaaagataaagagaatgtgccgaaatatctgaagcgtcttaagttagattatgcggggttttaccagattctgatgaatgacgacaaagtagtcgatgcgtacaagattatgaaacaacacatcctggcaaccttgacatccagtattcgtgtccctgcagcaattgagttagctactcagaaagaattgggcattgatgaactgatcgatgagatcatgaatttaccatccaagagttttggatatttcccaattgtgacagcagcaatcgaggaggctaacaaacgtgagaacaagcctttattccttttcaagatgagcaataaagacctttcatatgccgcaaccgccagcaagggcttacgtaaggggcgcggtacagagaaccttcattcaatgtatttgaaggcccttttgggtatgacccagagcgtatttgatattgggtcgggcatggtcttttttcgtcatcagacgaagggcctggccgaaacgacggcgcgccacaaggctaatgaattcgtggccaacaagaataaactgaacgataaaaagaagtccatctttggctacgaaattgtgaaaaataagcgcttcactgtggataagtatttatttaaactgtcaatgaacttgaactattcacaaccgaacaataataagattgatgtaaattcgaaagtgcgcgaaattatttctaacgggggcatcaagaatattattgggattgatcgtggcgaacgcaatctgttgtacttgtcccttatcgatcttaaaggcaacatcgtcatgcagaagtcccttaacattttaaaagatgatcataatgctaaggagacagattataagggtttgcttactgagcgcgagggggagaataaggaggcccgccgcaactggaaaaaaatcgcgaatattaaagatttaaaacgcggttacttaagccaagttgttcacatcatttccaagatgatggttgagtacaacgcgatcgtcgtccttgaggaccttaaccctggttttatccgtggtcgtcaaaagattgaacgcaatgtctacgaacaatttgagcgcatgttaattgataagttaaacttttacgtagacaaacataaaggcgccaacgaaaccggtggacttttgcacgcattacagcttacatcggaatttaaaaatttcaagaagagcgagcatcagaatgggtgtctgttttacatcccagcctggaacacctcaaagatcgaccccgctacgggctttgtcaaccttttcaacacgaaatatacgaacgcagtagaagctcaggagtttttctcaaaatttgatgagatccgttacaacgaagaaaaggattggtttgagtttgaatttgactacgacaagttcacacagaaggcgcatggaactcgcacgaaatggacactgtgcacgtatggaatgcgcctgcgtagtttcaagaatagtgctaagcaatacaattgggatagtgaggtcgtagctttgactgaggaattcaagcgtattttgggggaggctgggattgatatccacgaaaatcttaaagatgcaatctgcaatttggaaggtaaaagtcaaaaatacttggagccacttatgcaatttatgaagctgcttttgcagttacgcaattctaaagcgggcacggatgaagactacatcttatcgccagtggccgatgagaatggaatcttctacgattctcgttcttgcggagatcaattaccggagaatgcagatgcaaacggagcctataatatcgcgcgcaaagggcttatgttgatcgaacaaatcaagaatgcagaagacttgaataatgtcaaattcgatattagcaataaggcatggctgaactttgctcagcagaaaccttacaagaatggttga

SEQ ID NO: 948 - DNA, 2616 bp, synthetic construct
  misc_feature 1..2616: note = Description of Artificial Sequence: Synthetic polynucleotide
  source 1..2616: mol_type = other DNA
attaaagccattaacgagtactacaaacaacttggagcttactgccgcgaagaaggtaaagagaaagatgatttctttaagcgcattgacggtgcttattgcgccatcagccatttattcttcggcgagcatggggaaatcgctcagagtgactccgacgtggagttaatccagaagctgctggaagcctataaagggttacaacgctttatcaagccattactgggtcatggcgacgaagcggacaaggataacgaatttgatgcaaaacttcgcaaggtgtgggacgagttggacatcatcacgccactttacgataaagtgcgtaactggctttcacgcaaaatttataatccggagaagatcaagctgtgtttcgaaaacaatggtaagcttctgtctggatgggttgattcccgtacaaaatcagataacggcactcagtatggaggttacatttttcgcaagaaaaacgaaatcggcgagtatgacttctaccttggaatctcagctgataccaaactgttccgtcgtgacgccgcgatctcatatgacgacggaatgtacgagcgccttgactactaccagttgaagtctaaaacgctgcttggaaattcgtacgtgggcgattatgggttagactctatgaacttattgtctgccttcaagaatgcggcggtcaaatttcaattcgagaaggaggtggtgcccaaggataaggaaaacgtgcctaagtacttaaagcgcttaaagttagattatgctggattttaccaaatcttgatgaatgatgacaaggtagtagacgcttacaagatcatgaaacaacacatcttagcaactcttacatcctcaatccgtgtaccagccgctatcgaattggcgacacaaaaagagctgggaatcgacgaattgatcgatgaaatcatgaacttgccatccaaatcttttgggtacttcccgattgtgacggctgctatcgaagaggcaaacaaacgtgaaaataagcccttatttttgtttaaaatgagtaacaaagatttaagttatgccgcaacggctagcaagggattgcgcaagggtcgcggaacagaaaatttgcactccatgtacctgaaggcgttgcttgggatgacccaatctgtgttcgatattggtagcggcatggttttttttcgccatcagaccaagggtttagcagaaactacggcccgtcataaggccaacgaattcgtagcaaataaaaacaaactgaatgacaagaagaaaagtatctttgggtacgagatcgtgaagaacaaacgctttacagttgacaagtacttgttcaagcttagtatgaacctgaactactcacaacccaataataacaagatcgatgttaactcaaaggtacgcgagattattagcaacgggggtatcaaaaacatcattgggattgatcgtggtgagcgtaatctgttatacttgtccctgatcgacttgaaaggtaacatcgtcatgcaaaaaagcctgaatattcttaaggacgaccacaacgccaaggagacagactacaaaggcttgttaactgaacgtgaaggagaaaataaggaagcacgccgtaattggaaaaagatcgcaaacattaaggacctgaaacgcgggtacttgtctcaggtcgtccatattatttccaaaatgatggtcgaatataatgcgatcgtagtgcttgaagacctgaatcccggcttcatccgtgggcgtcaaaaaattgaacgtaatgtctatgaacagtttgagcgtatgttgattgacaaactgaacttctacgtagataagcataagggagcgaatgaaaccggcggccttttacacgcgttgcagttaacgagtgagttcaaaaacttcaaaaagtccgagcaccaaaatgggtgcctgttttacatccccgcgtggaatacgagtaagattgatcctgcaactgggttcgtgaacttatttaataccaaatatacgaatgccgttgaagcccaagaattcttctccaaattcgatgagatccgttacaatgaggaaaaagattggttcgagttcgagttcgactacgacaagtttacacagaaagctcatggtacgcgcactaagtggactttatgtacgtacggaatgcgtttgcgctcctttaaaaactctgcaaaacagtacaactgggacagcgaagtagtggcattaaccgaagaattcaagcgtattttaggggaagcgggtatcgatattcacgaaaatttaaaggatgctatttgtaatttggaaggcaaaagtcaaaagtacttggaaccgttaatgcaattcatgaaattgttgctgcaattgcgcaactcgaaagcggggaccgatgaagattatattctgagccctgtggcggacgagaacgggatcttttatgacagccgttcttgtggtgaccaacttcccgaaaatgctgatgcaaatggggcatataacattgctcgtaaaggattaatgctgatcgaacaaatcaaaaatgccgaagatttaaacaatgtcaagtttgatatcagtaacaaggcgtggttgaactttgctcagcaaaaaccgtataagaatggttga

SEQ ID NO: 949 - DNA, 2616 bp, synthetic construct
  misc_feature 1..2616: note = Description of Artificial Sequence: Synthetic polynucleotide
  source 1..2616: mol_type = other DNA
attaaggcaattaacgagtactacaaacaattaggcgcgtattgccgtgaagaaggaaaggaaaaggacgacttcttcaagcgtatcgatggtgcgtactgcgcgatcagccacctttttttcggggagcatggagaaattgcacagtccgattctgacgtagaattaatccagaagttattagaagcatataaaggcctgcaacgcttcatcaaaccgctgcttggacacggagatgaggcagataaagataatgagttcgatgctaagcttcgtaaagtctgggacgaattggacattatcacgccattgtatgataaggtccgtaattggctgtcccgcaagatttacaatcctgagaagattaaattatgtttcgagaacaatggcaaactgttgagtgggtgggtcgactctcgtaccaaatcggacaatggaacccagtacggggggtatatttttcgtaagaaaaacgagatcggcgaatacgacttttatttgggtattagtgcagacacaaagttattccgtcgcgatgcggcaatctcttacgatgacgggatgtacgaacgcttagattattatcagttaaaatcaaagaccttgcttggcaactcctacgtcggggattatgggttggacagcatgaacttgttgagtgcctttaagaacgcagccgtaaagtttcagtttgaaaaggaggtagtaccgaaagacaaagaaaacgttcctaaatatcttaaacgtctgaagttggactacgccgggttctaccaaattctgatgaacgacgataaggtagtagacgcctataagattatgaaacaacatattctggccacgttgacaagctctatccgcgtgccagcggctattgagttggcgactcaaaaggaattaggcatcgatgagttgatcgacgaaatcatgaatttgccaagcaagtcattcggttacttccctatcgttactgccgcgattgaagaagcaaacaaacgcgagaacaaaccgctgtttctgttcaaaatgtcgaacaaagacttgagctacgctgcaaccgcttccaaaggacttcgcaagggacgcggcacagaaaatttacactccatgtatttgaaggcattgttaggtatgacccaatcagtttttgacatcggttcgggtatggtattctttcgtcaccagacaaaaggacttgctgagacaacagcgcgccataaggccaacgagttcgtcgctaacaaaaacaagttaaacgacaaaaaaaagtccattttcggatatgaaatcgttaagaacaaacgctttacggttgataagtatctttttaaactgagcatgaacttgaattatagtcagcccaataataacaagatcgatgtcaattccaaagttcgcgagatcatttccaatggtggcatcaaaaacatcatcgggattgaccgcggagaacgtaatttactgtatttatcgttgatcgacctgaaggggaatatcgtaatgcaaaaaagtctgaatatccttaaagatgaccacaacgcaaaggaaacggactacaaggggttattaaccgagcgcgagggcgagaataaagaagcacgccgtaattggaagaaaatcgcgaacatcaaagacttgaagcgcggctacttatcgcaagtggtacatattatctccaagatgatggttgagtacaacgcgatcgtagtattagaagatcttaatccaggatttatccgcgggcgtcagaagattgaacgcaacgtgtatgagcagtttgagcgcatgcttattgataaattgaatttttatgttgataaacataaaggtgcaaatgaaacagggggcttattgcatgctctgcaacttacttcggaatttaagaattttaagaagtcggagcatcagaatgggtgtttattttatatccccgcatggaatacctccaagattgatcccgccacagggttcgttaatctgttcaacacgaaatacaccaatgctgttgaggcacaggaattcttctccaagtttgacgagattcgctacaatgaggaaaaggactggtttgaatttgagtttgactacgacaagtttactcaaaaggcacatggtacacgcaccaaatggacgctttgcacgtacggtatgcgtttacgctcattcaaaaacagcgccaaacaatacaactgggactccgaagtcgtcgcactgactgaggagtttaaacgtattttgggggaagcaggtatcgatattcacgaaaacttgaaggatgctatctgtaacctggagggtaagagccaaaaatacttggagccattaatgcagttcatgaagttgcttctgcaattgcgcaattcgaaagcagggacagatgaggattatattttaagccccgtcgcagacgagaacggcattttctatgatagtcgctcttgtggtgaccaacttccagaaaatgcagacgcgaacggcgcatataacattgctcgcaaagggcttatgctgattgaacaaattaagaatgcggaagacctgaacaacgtaaagtttgacatctcgaacaaggcatggttaaacttcgcacagcagaagccatacaagaatggttga

SEQ ID NO: 950 - protein, 1244 aa, Phocaeicola plebeius
METFSGFTNLYPLSKTLRFRLIPVGETLKHFIDSGILEEDQHRAESYVKVKAIIDDYHRAYIENSLSGFELPLESTKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 951 - protein, 1197 aa, Sulfurimonas crateris
MLSNFTNQYQLSKTLRFELKPVGDTLKHIEKSGLIAQDEIRSQEYQEVKTIIDKYHKAFIDEALQNVVLSNLEEYEALFFERNRDEKAFEKLQAVLRKEIVAHFKQHPQYKTLFKKELIKADLKNWQELSDAEKELVSHFDNFTTYFTGFHENRANMYTDEAKHSSIAYRIIHENLPIFLTNKKLFETIKQKAPHLAQETQDALLEYLSGAIVEDMFELSYFNHLLSQTHIDLYNQMIGGVKQDSLKIQGLNEKINLYRQANGLSKRELPNLKPLHKQILSDRETLSWLPESFESDEELMQGVQAYFESEVLAFECCDGKVNLLEKLPELLHQTQDYDFSKVYFKNDLALTAASQAIFKDYRIIKEALWEVNKPKKSKDLVADEEKFFNKKNSYFSIEQIDGALNSAQLSANMMHYFQSESTKVIEQIQLTYNDWKRNSSNKELLKAFLDALLSYQRLLKPLNAPNDLEKDVAFYAYFDAYFTSLCGVVKLYDKVRNFMTKKPYSLEKFKLNFENSTLLDGWDVNKESDNTAILFRKEGLYYLGIMNKKYNKVFRNISSSQDEGYQKIDYKLLPGANKMLPKVFFSDKNKEYFKPNAKLLERYKAGEHKKGDNFDLDFCHELIDFFKTSIEKHQDWKHFAYQFSPTESYEDLSGFYREVEQQGYKISYKNIAASFIDTLVAEGKLYFFQIYNKDFSPYSKGTPNMHTLYWRALFDEKNLADVIYKLNGQAEIFFRKKSIEYSQEKLQKGHHHEMLKDKFAYPIIKDRRFAFDKFQFHVPITLNFKAEGNENITPKTFEYIRSNPDNIKVIGIDRGERHLLYLSLIDAEGKIVEQFTLNQIINSYNGKDHVIDYHAKLDAKEKDRDKARKEWGTVENIKELKEGYLSHVIHKIATLIIEHGAVVAMEDLNFGFKRGRFKVEKQVYQKFEKALIDKLNYLVDKKKEPHKLGGLLNALQLTSKFQSFEKMGKQNGFLFYVPAWNTSKIDPVTGFVNLFDTRYASVEKSKAFFTKFQSICYNEAKDYFELVFDYNDFTEKAKETRSEWTLCTYGERIVSFRNAEKNHQWDSKTIHLTTEFKNLFGELHGNDVKEYILEQNSVEFFKSLIYLLKITLQMRNSITGTDIDYLVSPVADEAGNFYDSRKADTSLPKDADANGAYNIARKGLMLMHRIQNAEDLKKVNLAISNRDWLRNAQGLDK

SEQ ID NO: 952 - protein, 1252 aa, Prevotella ruminicola
MIDLKQFIGIYPVSKTLRFELRPVGKTQEWIEKNRVLEGDEQKAADYPVVKKLIDDYHKVCIHDSLNHVHFDWEPLKDAIEIFQKTKSDEAKKRLEAEQAMMRKKIAAAIKDFKHFKELTAATPSDLITSVLPEFSDDGSLKSFRGFATYFSGFQENRNNIYSQEAISTGVPYRLVHDNFPKFLSDLEVFERIKSTCPEVINQASAELQPFLEGVMIDDIFSLDFYNSLLTQNGIDFFNQVIGGVSEKDKQKYRGINEFSNLYRQQHKEIAASKKAMTMIPLFKQILSDRDTLSYIPAQIRTEDELVSSITQFYDHITHFEHDGKTINVLSEIVALLGKLDTYDPNGICITARKLTDISQKVYGKWSVIEEKMKEKAIQQYGDISVAKNKKKVDAFLSRKAYSLSDLCFDEEISFSRYYSELPQTLNAISGYWLQFNEWCKSDEKQKFLNNQTGTEVVKSLLDAMMELFHKCSVLVMPEEYEVDKSFYNEFLPLYEELDTLFLLYNKVRNYLTQKPSDVKKFKLNFESPSLASGWDQNKEMKNNAILLFKDGKSYLGVLNAKNKAKIKDAKGDVSSSSYKKMIYKLLSDPSKDLPHKIFAKGNLDFYKPSEYILEGRELGKYKKGPNFDKKFLHDFIDFYKAAISIDPDWSKFNFQYSPTESYDDIGMFFSEIKKQAYKIRFTDISEAQVNEWVDNGQLYLFQLYNKDYAEGAHGRKNLHTLYWENLFTDENLSNLVLKLNGQAELFCRPQSIKKPVSHKIGSKMLNRRDKSGMPIPESIYRSLYQYYNGKKKESELTVAEKQYIDQVIVKDVTHEIIKDRRYTRQEYFFHVPLTFNANADGNEYINEHVLNYLKDNPDVNIIGIDRGERHLIYLTLINQRGEILKQKTFNVVNSYNYQAKLEQREKERDEARKSWDSVGKIKDLKEGFLSAVIHEITNMMIENNAIVVLEDLNFGFKRGRFKVERQVYQKFEKMLIDKLNYLSFKDREAGEEGGILRGYQMAQKFISFQRLGKQSGFLFYIPAAYTSKIDPVSGFVNHFNFSDITNAEKRKDFLMKMDRIEMKNGNIEFTFDYRKFKTFQTDYQNVWTVSTFGKRIVMRIDEKGYKKMVDYEPTNDIIKAFKNKGILLSEGSDLKALIAEIEANATNAGFYSTLLYAFQKTLQMRNSNAVTEEDYILSPVAKDGHQFCSTDEANKGKDAQGNWVSKLPVDADANGAYHIALKGLYLLRNPETKKIENEKWLQFMVEKPYLE

SEQ ID NO: 953 - protein, 1287 aa, Clostridium sp.
MSYNREKMEEKELGKNQNFQEFIGVSPLQKTLRNELIPTETTKKNIAQLDLLTEDEVRAQNREKLKEMMDDYYRDVIDSTLRGELLIDWSYLFSCMRNHLSENSKESKRELERTQDSVRSQIHDKFAERADFKDMFGASIITKLLPTYIKQNSKYSERYDESVKIMKLYGKFTTSLTDYFETRKNIFSKEKISSAVGYRIVEENAEIFLQNQNAYDRICKIAGLDLHGLDNEITAYVDGKTLKEVCSDEGFAKVITQGGIDRYNEAIGAVNQYMNLLCQKNKALKPGQFKMKRLHKQILCKGTTSFDIPKKFENDKQVYDAVNSFTEIVTKNNDLKRLLNITQNANDYDMNKIYVVADAYSMISQFISKKWNLIEECLLDYYSDNLPGKGNAKENKVKKAVKEETYRSVSQLNEVIEKYYVEKTGQSVWKVESYISSLAEMIKLELCHEIDNDEKHNLIEDDEKISEIKELLDMYMDVFHIIKVFRVNEVLNFDETFYSEMDEIYQDMQEIVPLYNHVRNYVTQKPYKQEKYRLYFHTPTLANGWSKSKEYDNNAIILVREDKYYLGILNAKKKPSKEIMAGKEDCSEHAYAKMNYYLLPGANKMLPKVFLSKKGIQDYHPSSYIVEGYNEKKHIKGSKNFDIRFCRDLIDYFKECIKKHPDWNKFNFEFSATETYEDISVFYREVEKQGYRVEWTYINSEDIQKLEEDGQLFLFQIYNKDFAVGSTGKPNLHTLYLKNLFSEENLRDIVLKLNGEAEIFFRKSSVQKPVIHKCGSILVNRTYEITESGTTRVQSIPESEYMELYRYFNSEKQIELSDEAKKYLDKVQCNKAKTDIVKDYRYTMDKFFIHLPITINFKVDKGNNVNAIAQQYIAEQEDLHVIGIDRGERNLIYVSVIDMYGRILEQKSFNLVEQVSSQGTKRYYDYKEKLQNREEERDKARKSWKTIGKIKELKEGYLSSVIHEIAQMVVKYNAIIAMEDLNYGFKRGRFKVERQVYQKFETMLISKLNYLADKSQAVDEPGGILRGYQMTYVPDNIKNVGRQCGIIFYVPAAYTSKIDPTTGFINAFKRDVVSTNDAKENFLMKFDSIQYDIEKGLFKFSFDYKNFATHKLTLAKTKWDVYTNGTRIQNMKVEGHWLSMEVELTTKMKELLDDSHIPYEEGQNILDDLREMKDITTIVNGILEIFWLTVQLRNSRIDNPDYDRIISPVLNNDGEFFDSDEYNSYIDAQKAPLPIDADANGAFCIALKGMYTANQIKENWVEGEKLPADCLKIEHASWLAFMQGERG

SEQ ID NO: 954 - protein, 1295 aa, Limihaloglobus sulfuriphilus
MSAVFKIKESTMKDFTHQYSLSKTLRFELKPVGETAERIEDFKNQGLKSIVEEDRQRAEDYKKMKRILDDYHKEFIEEVLNDDIFTANEMESAFEVYRKYMASKNDDKLKKEITEIFTDLRKKIAKAFENKSKEYCLYKGDFSKLINEKKTGKDKGPGKLWYWLKAKADAGVNEFGDGQTFEQAEEALAKFNNFSTYFTGFNQNRDNIYTDAEQQTAISYRVINENMTRYFDNCIRYSSIENKYPELVKQLEPLSGKFAPGNYKDYLSQTAIDIYNEAVGHKSDDINAKGINQFINEYRQRNSIKGRELPIMSVLYKQILSDINKDLIIDKFENAGELLDAVKTLHRELTDKKILLKIKQTLNEFLTEDNSEDIYIKSGTDLTAVSNAIWGEWSVIPKALEMYAENITDMNAKAREKWLKREAYHLKTVQEAIEAYLKDNEEFETRNISEYFTNFKSGENDLIQVVQSAYAKMESIFGIEDFHKDRRPVTESGEPGEGFRQVELVREYLDSLINVEHFIKPLHMFRSGKPIELEDCNSNFYDPLNEAYKELDVVFGIYNKVRNYVTQKPYSKDKFKINFQNSTLLDGWDVNKESANSSVLLLKNGKYYLGVMKQGASNILNYRPEPSDSKNKINAKKQLSEIALAGATDDYYEKMIYKLLPDPAKMLPKVFFSAKNIEFYNPSQEIIYIRENGLFKKDAGDKESLKKWIGFMKTSLLKHPEWGSYFNFEFEPAEDYQDISIFYKQVAEQGYSVTFDKIKTSYIEEKVASGELYLFEIYNKDFSPHSKGRPNLHTMYWKSLFEKENLQNLVTKLNGEAEVFFRQHSIKRNEKVVHRANRPIQNKNPLTEKKQSIFEYDLVKDRRFTKDKFFLHCPITLNFKEAGPGRFNDKVNKYIAGNPDIRIIGIDRGERHLLYYSLIDQSGRIVEQGTLNQITSTLNSGGREIPKTTDYRGLLDTKEKERDKARKSWSMIENIKELKSGYLSHIVHKLAKLMVKNNAVVVLEDLNFGFKRGRFKVEKQVYQKFEKALIEKLNYLVFKDARPAEPGHYLNAYQLTAPLESFKKLGKQSGFIYYVPAWNTSKIDPVTGFVNQFYIEKNSMQYLKNFFGKFDSIRFNPDKNYFEFGFDYKNFHNKAAKSKWTICTHGDKRSWYNRKQRKLEIHNVTENLASLLSGKGINFADGGSIKDKILSVDDASFFKSLAFNFKLTAQLRHTFEDNGEEIDCIISPVAAADGTFFCSETAKKLNMELPHDADANGAYNIARKGLMVLRQIRESGKPKPISNADWLDFAQQNED

SEQ ID NO: 955 - protein, 1245 aa, Ruminococcus bromii
MQERKKISHLTHRNSVQKTIRMQLNPVGKTMDYFQAKQILENDEKLKENYQKIKEIADRFYRNLNEDVLSKTGLDKLKDYAEIYYHCNTDAERKRLDECASELRKEIVKNFKNRDEYNKLFNKKMIEIVLPQHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVNYYKTSLMQLTDNLSDKYNEAAPLLNKSYANEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCRDEKYYLAIIDKSNNSILENIDFQDCDENDCYEKIIYKLLPGPNKMLPKVFFSEKCKKLLSPSDEILKIRKNGTFKKGDKFSLDDCHKLIDFYKESFKKYPNWLIYNFKFKNTNEYNDIREFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKKTSTFPYDLIKDKRYTKWQFSLHFPITMNFKAPDRAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEGGGLLHAYQLTNKLESFDKLGMQSGFIFYVRPDFTSKIDPVTGFVNLLYPRYENIDKAKDMISRFDDIGYNAGEDFFEFDIDYDKFPKTASDYRKRWTICTNGERIEAFRNPAKNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKSDNVSTVGPVIHNDKWLKFVQENDMANN

SEQ ID NO: 956 - protein, 1281 aa, Prevotella sp.
MNILKENYMKEIKELTGLYSLTKTIGVELKPVGKTQELIEAKKLIEQDDQRAEDYKIVKDIIDRYHKDFIDKCLNCVKIKKDDLEKYVSLAENSNRDAEDFDKIKTKMRNQITEAFRKNSLFTNLFKKNLIKEYLPAFVSEEEKSVVNKFSKFTTYFDAFNDNRKNLYSGDAKSGTIAYRLIHENLPMFLDNIASFNAISGIGVNEYFSSIETEFTDTLEGKRLTEFFQIDFFNNTLTQKKIGNYNYIVGAVNKAVNLYKQQHKTVRVPLLKPLYKMILSDRVTPSWLPERFESDEEMLTAIKAAYESLREVLVGDNDESLRNLLLNIEHYDLEHIYIANDSGLTSISQKIFGCYDTYTLAIKDQLQRDYPATKKQREAPDLYDERIDKLYKKVGSFSIAYLNRLVDAKGHFTINEYYKQLGAYCREEGKEKDDFFKRIDGAYCAISHLFFGEHGEIAQSDSDVELIQKLLEAYKGLQRFIKPLLGHGDEADKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAISYDDGMYERLDYYQLKSKTLLGNSYVGDYGLDSMNLLSAFKNAAVKFQFEKEVVPKDKENVPKYLKRLKLDYAGFYQILMNDDKVVDAYKIMKQHILATLTSSIRVPAAIELATQKELGIDELIDEIMNLPSKSFGYFPIVTAAIEEANKRENKPLFLFKMSNKDLSYAATASKGLRKGRGTENLHSMYLKALLGMTQSVFDIGSGMVFFRHQTKGLAETTARHKANEFVANKNKLNDKKKSIFGYEIVKNKRFTVDKYLFKLSMNLNYSQPNNNKIDVNSKVREIISNGGIKNIIGIDRGERNLLYLSLIDLKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKGANETGGLLHALQLTSEFKNFKKSEHQNGCLFYIPAWNTSKIDPATGFVNLFNTKYTNAVEAQEFFSKFDEIRYNEEKDWFEFEFDYDKFTQKAHGTRTKWTLCTYGMRLRSFKNSAKQYNWDSEVVALTEEFKRILGEAGIDIHENLKDAICNLEGKSQKYLEPLMQFMKLLLQLRNSKAGTDEDYILSPVADENGIFYDSRSCGDQLPENADANGAYNIARKGLMLIEQIKNAEDLNNVKFDISNKAWLNFAQQKPYKNG

SEQ ID NO: 957 - protein, 1293 aa, unidentified
  REGION 1..1293: note = Description of Unknown: Parcubacteria group bacterium Gr01-1014_33 sequence
MAKENIFNELTGKYQLSKTLRLELKPVGNTQQMLKDEDVFEKDRIIREKYRETRPHFDRLHREFIEQALKNQKLSDLGKYFQCLAKLQNNKKDKEAQEEFKRISQNLRKEVNDLFKIDPLFGEGVFALLKEKYGEKDDAFLREQDGQYVLDENKKKISIFDSWKGFTGYFTKFQETRKNFYKDDGTATAVATRIIDQNLKRFCENIQIFKSIQKKVDFKEVEDNFSVDLEDIFSLGFYSSCFLQEGIDVYNKILGGEPKTTGEKLRGLNELINRYRQDHKGEKLPFFKMLDKQILSEKEKFIESIEDDEELLKTLKEFYSSAEEKTTVLKELFNDFIKNNENYDLSEIYISREALNTISHRWVSAATLPEFEKSVYEVMKKDKPSGLSFDKDDNSYKFPDFIALSYIKGSFEKLSGEKLWKDGYFRDETRNGDKGFLIGNESLWTQFIKIFEFEFNSLFEAKNTERSVGYYHFKKDFEKIITNDFSVNPEDKVIIREFADNVLAIYQMAKYFAIEKKRKWMDQYDTGDFYNHPDFGYKTKFYDNAYEKIVKARMLLQSYLTKKPFSTDKWKLNFECGYLLNGWSSSFNTYGSLLFRTGNEYYLGVVNGSALRTEKIKRLTGNITEANSCHKMVYDFQKPDNKNVPRIFIRSKGDKFAPAVSELNLPVDSILEIYDKGLFKTENKNSPFFKPSLKKLIDYFKLGFSRHASYKHYQFKWKDSSEYKNISEFYNDTIRSCYQIKWEELNFEEVKKLTNSKDLFLFQIYNKDFSEKSTGNKNLHSIYFDGLFLDNNINAQDGVILKLSGGGEIFFRPKTDVKKLGSRTDTKGKLVIKNKRYSQDKIFLHFPIELNYSNTQESNFNKLVRNFLADNPDINIIGVDRGEKHLIYYAGIDQKGNTLKDKDDKDVLGSLNEINGVNYYKLLEERAKAREKARQDWQNIQGIKDLKMGYISLVVRKLADLIIEYNAILVLEDLNMRFKQIHGGIEKSVYQQLEKALIEKLNFLVNKGEKDPERAGHLLRAYQLTAPFSTFKDMGKQTGVLFYTQASYTSKTCPQCGFRPNIKLHFDNLENAKKMLEKINIVYKDNHFEIGYKVSDFTKTEKTSRGNILYGDRQGKDTFVISSKAAIRYKWFARNIKNNELNRGESLKEHTEKGVTIQYDITECLKILYEKNGIDHSGDITKQSIRSELPAKFYKDLLFYLYLLTNTRSSISGTEIDYINCPDCGFHSEKGFNGCIFNGDANGAYNIARKGMLILKKINQYKDQHHTMDKMGWGDLFIGIEEWDKYTQVVSRS

SEQ ID NO: 958 - protein, 1273 aa, Prevotella sp.
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDKIKTKMRNQITEAFRKNSLFTNLFKKNLIKEYLPAFVSEEEKSVVNKFSKFTTYFDAFNDNRKNLYSGDAKSGTIAYRLIHENLPMFLDNIASFNAISGIGVNEYFSSIETEFTDTLEGKRLTEFFQIDFFNNTLTQKKIGNYNYIVGAVNKAVNLYKQQHKTVRVPLLKPLYKMILSDRVTPSWLPERFESDEEMLTAIKAAYESLREVLVGDNDESLRNLLLNIEHYDLEHIYIANDSGLTSISQKIFGCYDTYTLAIKDQLQRDYPATKKQREAPDLYDERIDKLYKKVGSFSIAYLNRLVDAKGHFTINEYYKQLGAYCREEGKEKDDFFKRIDGAYCAISHLFFGEHGEIAQSDSDVELIQKLLEAYKGLQRFIKPLLGHGDEADKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAISYDDGMYERLDYYQLKSKTLLGNSYVGDYGLDSMNLLSAFKNAAVKFQFEKEVVPKDKENVPKYLKRLKLDYAGFYQILMNDDKVVDAYKIMKQHILATLTSSIRVPAAIELATQKELGIDELIDEIMNLPSKSFGYFPIVTAAIEEANKRENKPLFLFKMSNKDLSYAATASKGLRKGRGTENLHSMYLKALLGMTQSVFDIGSGMVFFRHQTKGLAETTARHKANEFVANKNKLNDKKKSIFGYEIVKNKRFTVDKYLFKLSMNLNYSQPNNNKIDVNSKVREIISNGGIKNIIGIDRGERNLLYLSLIDLKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKGANETGGLLHALQLTSEFKNFKKSEHQNGCLFYIPAWNTSKIDPATGFVNLFNTKYTNAVEAQEFFSKFDEIRYNEEKDWFEFEFDYDKFTQKAHGTRTKWTLCTYGMRLRSFKNSAKQYNWDSEVVALTEEFKRILGEAGIDIHENLKDAICNLEGKSQKYLEPLMQFMKLLLQLRNSKAGTDEDYILSPVADENGIFYDSRSCGDQLPENADANGAYNIARKGLMLIEQIKNAEDLNNVKFDISNKAWLNFAQQKPYKNG

SEQ ID NO: 959 - protein, 1300 aa, Acinetobacter indicus
MNFQPFFQKFVHLYPISKTLRFELIPQGATQKFISEKQVLLQDEIRARKYPEMKQAIDGYHKDFIQRALSNIDSQVFEQALNTFEDLFLRSQAERATDAYKKDFETAQTKLRELIVHSFEKGEFKQEYKSLFDKNLITNLLKPWVEQQNQIGDSNYTYHEDFNKFTTYFLGFHENRKNIYSKDPHKTALAYRLIHENLPKFLENNKILLKIQNDHPSLWEQLQTLNQTMPQLFDGWDFSQLMQVSFFSNTLTQTGIDQYNTIIGGISEGENRQKIQGINELINLYNQKQDKKNRVAKLKQLYKQILSDRSTLSFLPEKFVDDTELYHAINMFYLEHLHHQSMINGHSYTLLERVQLLINELANYDLSKVYLAPNQLSTVSHQMFGDFGYIGRALNYYYMQVIQPDYEQLLASAKTTKKIEATEKLKTIFLDTPQSLVVIQAAIDEYIQLQPSTKPHTQLTDFIISLLKQYETVADDQSIKVINVFSDIEGKYSCIKGLVNTKSESKREVLQDEKLATDIKAFMDAVNNVIKLLKPFSLNEKLVASVEKDARFYSDFEEIYQSLLIFVPLYNKVRNYITQKPYSTEKFKLNFNKPTLLSGWDANKEADNLSILLRKNGNYYLAIMDTAKGANKAFEPKTLNQLKVDDTTDCYEKMVYKLLSGPSKMFPKAFKAKNNEGNYYPTPELLTSYNNNEHLKNDKNFTLASLHAYIDWCKEYINRNPSWHQFNFKFSPTQSFQDISQFYSEVSSQSYKVHFQTIPSDYIDQLVAEGKLYLFQIYNKDFSPNAKGKENLHTLYFKALFSDENLKQPVFKLSGEAEMFYRPASLQLANTTIHKAGEPMAAKNPLTPNATRTLAYDIIKDRRFTTDKYLLHVPISLNFHAQESMSIKKHNDLVRQMIKHNHQDLHVIGIDRGEKHLLYVSVIDLKGNIVYQESLNSIKSEAQNFETPYHQLLQHREEGRAQARTAWGKIENIKELKDGYLSQVVHRIQQLILKYNAIVMLEDLNFGFKRGRFKIEKQIYQKFEKALIHKLNYVVDKSTQADELGGVRKAYQLTAPFESFEKLGKQSGVLFYVPAWNTSKIDPVTGFVDLLKPKYENLDKAQAFFNAFDSIHYNAQKNYFEFKVNLKQFAGLKAQAAQAEWTICSYGDERHVYQKKNAQQGETVIVNVTEELKVLFAKNNIEVAQSVELKETICTQTQVDFFKRLMWLLQVLLALRYSSSKDKLDYILSPVANAQGEFFDSRHASVQLPQDSDANGAYHIALKGLWVIEQLKAADNLDKVKLAISNDDWLHFAQQKPYLA

SEQ ID NO: 960 - protein, 1205 aa, Pseudobutyrivibrio xylanivorans
MYYQGLTKLYPISKTIRNELIPVGKTLEHIRMNNILEADIQRKSDYERVKKLMDDYHKQLINESLQDVHLSYVEEAADLYLNASKDKDIVDKFSKCQDKLRKEIVNLLKSHENFPKIGNKEIIKLLQSLSDTEKDYNALDSFSKFYTYFTSYNEVRKNLYSDEEKSSTAAYRLINENLPKFLDNIKAYSIAKSAGVRAKELTEEEQDCLFMTETFERTLTQDGIDNYNELIGKLNFAINLYNQQNNKLKGFRKVPKMKELYKQILSEREASFVDEFVDDEALLTNVESFSAHIKEFLESDSLSRFAEVLEESGGEMVYIKNDTSKTTFSNIVFGSWNVIDERLAEEYDSANSKKKKDEKYYDKRHKELKKNKSYSVEKIVSLSTETEDVIGKYIEKLQADIIAIKETREVFEKVVLKEHDKNKSLRKNTKAIEAIKSFLDTIKDFERDIKLISGSEHEMEKNLAVYAEQENILSSIRNVDSLYNMSRNYLTQKPFSTEKFKLNFNRATLLNGWDKNKETDNLGILLVKEGKYYLGIMNTKANKSFVNPPKPKTDNVYHKVNYKLLPGPNKMLPKVFFAKSNLEYYKPSEDLLAKYQAGTHKKGENFSLEDCHSLISFFKDSLEKHPDWSEFGFKFSDTKKYDDLSGFYREVEKQGYKITYTDIDVEYIDSLVEKDELYLFQIYNKDFSPYSKGNYNLHTLYLTMLFDERNLRNVVYKLNGEAEVFYRPASIGKDELIIHKSGEEIKNKNPKRAIDKPTSTFEYDIVKDRRYTKDKFMLHIPVTMNFGVDETRRFNEVVNDAIRGDDKVRVIGIDRGERNLLYVVVVDSDGTILEQISLNSIINNEYSIETDYHKLLDEKEGDRDRARKNWTTIENIKELKEGYLSQVVNVIAKLVLKYDAIICLEDLNFGFKRGRQKVEKQVYQKFEKMLIDKLNYLVIDKSRSQENPEEVGHVLNALQLTSKFTSFKELGKQTGIIYYVPAYLTSKIDPTTGFANLFYVKYESVEKSKDFFNRFDSICFNKVAGYFEFSFDYKNFTDRACGMRSKWKVCTNGERIIKYRNEEKNSSFDDKVIVLTEEFKKLFNEYGIAFNDCMDLTDAINAIDDASFFRKLTKLFQQTLQMRNSSADGSRDYIISPVENDNGEFFNSEKCDKSKPKDADANGAFNIARKGLWVLEQLYNSSSGEKLNLAMTNAEWLEYAQQHTI

SEQ ID NO: 961 - protein, 1306 aa, Prevotella sp.
MAKNFEDFKRLYPLSKTLRFEAKPIGATLDNIVKSGLLEEDEHRAASYVKVKKLIDEYHKVFIDRVLDNGCLPLDDKGDNNSLAEYYESYVSKAQDEDAIKKFKEIQQNLLSIIAKKLTDDKAYANLFGNKLIESYKDKADKTKLIDSDLIQFINTAESTQLVSMSQDEAKELVKEFWGFTTYFEGFFKNRKNMYTPEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKHVAPARKHKESEEDYEKRIAGIFKKADSFSISYINDCLNEADPNNAYFVENYFATFGAVNTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSRKLLGKAMPSDGECYEKMVYKFFKDVTTMIPKCSTQLKDVQAYFKVNTDDYVLNSKAFNRPLTITKEVFDLNNVLYGKYKKFQKGYLTATGDNVGYTHAVNVWIKFCMDFLDSYDSTCIYDFSSLKPESYLSLDSFYQDVNLLLYKLSFTDVSASFIDQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSSGSENINQDVKAYLRHADDMHIIGIDRGERHLLYLVVIDLQGNIKEQFSLNEIVNDYNGNTYHTNYHDLLDVREDERLKARQSWQTIENIKELKEGYLSQVIHKITQLMVRYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISTQTDKAFFTGLLHILKLTLQMRNSITGTETDYLVSPVADENGIFYDSRSCGDQLPENADANGAYNIARKGLMLVEQIKDAEDLDNVKFDISNKAWLNFAQQKPYKNG

SEQ ID NO: 962 - protein, 1306 aa, Prevotella copri
MAKNFEDFKRLYSLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSRKLLGKAMPSDGECYEKMVYKFFKDVTTMIPKCSTQLKDVQAYFKVNTDDYVLNSKAFNKPLTITKEVFDLNNVLYGKYKKFQKGYLTATGDNVGYTHAVNVWIKFCMDFLNSYDSTCIYDFSSLKPESYLSLDAFYQDANLLLYKLSFARASVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVRYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISAQTDKAFFTGLLHILKLTLQMRNSITGTETDYLVSPVADENGIFYDSRSCGNQLPENADANGAYNIARKGLMLIEQIKNAEDLNNVKFDISNKAWLNFAQQKPYKNG

SEQ ID NO: 963 - protein, 1274 aa, Prevotella copri
MAKNFEDFKRLYSLSKTLRFEAKPIGATLDNIVKSDLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINDYINLYNQKHKDDKLPKLKALFKQILSDRNAISWLPEEFNSDQEVLNAIKDCYERLSENVLGDKVLKSMLGSLADYSLDGIFIRNDLQLTDISQKMFGNWSVIQNAIMQNIKHVAPARKHKESEEEYENRIAGIFKKADSFSISYIDACLNETDPNNAYFVENYFATLGAVDTPTMQRENLFALVQNAYTEITALLHSDYPTEKNLAQDKANVAKIKALLDAIKSLQHFVKPLLGKGDESDKDERFYGELASLWAELDTMTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYYNGTHKKGKNFNIQDCHNLIDYFKQSIDKHEDWSKFGFKFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFGYDLIKDRRYTVDKFLFHVPITMNFKSSGSENINQDVKAYLRHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASVSGGLLNAYQLTSKFDSFQKLGKQSGFLFYIPAWNTSKIDPVTGFVNLLDTRYQNVEKAKSFFSKFDAIRYNKDKEWFEFNLDYDKFGKKAEGTRTKWTLCTRGMRIDTFRNKEKNSQWDNQEVDLTAEMKSLLEHYYIDIHSNLKDAISAQTDKAFFTGLLHILKLTLQMRNSITGTETDYLVSPVVDENGIFYDSRSCGDELPENADANGAYNIARKGLMMIEQIKDAKDLDNLKFDISNKAWLNFAQQKPYKNG

SEQ ID NO: 964 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDELQKQLKDLQAVLRKESVKPIGNGGKYKAGHDRLFGAKLFKDGKELGDLAKFVIAQEGKSSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIKHHTARHDDESVQAGKLGQYFKHGLAGVDNPIQKIHNNHSTIKGFLERERPAGERALPKIKSGKNPEMTQLRQLKELLDNALNVAHFAKLLMTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMIYKLLPGPNKMLPRVFFAKSNLDYYNPSAELLDKYAQGTHKKGDNFNLKDCHALIDFFKAGINKHPEWQNFGFKFSPTSSYRDLSDFYREVEPQGYQVKFVDINADYIDELVEQGQLYLFQIYNKDFSPKAHGKPNLHTLYFRALFSEDNLANPIYKLNGEAQIFYRKASLGMNETTIHRAGEILENKNPDNPKERVFTYDIIKDRRYTQDKFMLHVPITMNFGVQGMTIKEFNKKVNQSIRQYDDVNVIGIDRGERHLLYLTVINSKGEILEQRSLNDITTASANGTQMTTPYHKILDKREIERLNARVGWGEIETIKELKSGYLSHVVHQVSQLMLKYNAIVVLEDLNFGFKRGRFKVEKQIYQNFENALIKKLNHLELKDKADDEIGSYKNALQLTNNFTDLKNIGKQTGFLFYVPAWNTSKIDPETGFVDLLKPRYENIAQSQAFFGKFDKICYNADKDYFEFHIDYAKFTDKAKNSRQTWTICSHGDKRYVYDKTANQNKGATKGINVNDELKSLFARYHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 965 - protein, 1251 aa, Moraxella lacunata
MLFQDFTHLYPLSKTVRFELKPIGKTLEHIHAKNFLSQDETMADMYQKVKAILDDYHRDFITKMMSEVTLTKLPEFYEVYLALRKNPKDDTLQKQLTEIQTALREEVVKPIDSGGKYKAGYERLFGAKLFKDGKELGDLAKFVIAQEGESSPKLPQIAHFEKFSTYFTGFHDNRKNMYSSDDKHTAIAYRLIHENLPRFIDNLQILVTIKQKHSVLYDQIVNELNANGLDVSLASHLDGYHKLLTQEGITAYNRIIGEVNSYTNKHNQICHKSERIAKLRPLHKQILSDGMGVSFLPSKFADDSEMCQAVNEFYRHYAHVFAKVQSLFDRFDDYQKDGIYVEHKNLNELSKQAFGDFALLGRVLDGYYVDVVNPEFNDKFAKAKTDNAKEKLTKEKDKFIKGVHSLASLEQAIEHYIAGHDDESVQAGKLGQYFKHGLAGVDNPIQKIHNSHSTIKGFLERERPAGERTLPKIKSDKSLEMTQLRQLKELLDNALNVVHFAKLLTTKTTLDNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMVYKLLPGPNKMLPKVFFAKSNLDYYNPSAELLDKYAQGTHKKGDNFNLKDCHALIDFFKASINKHPEWQHFGFEFSLTSSYQDLSDFYREVEPQGYQVKFVDIDADYIDELVEQGQLYLFQIYNKDFSPKAHGKPNLHTLYFKALFSEDNLANPIYKLNGEAEIFYRKASLDMNETTIHRAGEVLENKNPDNPKERQFVYDIIKDKRYTQDKFMLHVPITMNFGVQGMTIKEFNKKVNQSIQQYDEVNVIGIDRGERHLLYLTVINSKGEILEQRSLNDIITTSANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADNEIGSYKNALQLTNNFTDLKSIGKQTGFLFYVPAWNTSKIDPVTGFVDLLKPRYENIAQSQAFFDKFDKICYNADKGYFEFHIDYAKFTDKAKNSRQIWTICSHGDKRYVYDKTANQNKGATIGINVNDELKSLFARYRINDKQPNLVMDICQNNDKEFHKSLTYLLKALLALRYSNASSDEDFILSPVANDKGVFFNSALADDTQPQNADANGAYHIALKGLWLLNELKNSDDLDKVKLAIDNQTWLNFAQNR

SEQ ID NO: 966 - protein, 1251 aa, Moraxella lacunata
MLFQDFTHLYPLSKTVRFELKPIGKTLEHIHAKNFLSQDETMADMYQKVKAILDDYHRDFITKMMSEVTLTKLPEFYEVYLALRKNPKDDTLQKQLTEIQTALREEVVKPIDSGGKYKAGYERLFGAKLFKDGKELGDLAKFVIAQEGESSPKLPQIAHFEKFSTYFTGFHDNRKNMYSSDDKHTAIAYRLIHENLPRFIDNLQILVTIKQKHSVLYDQIVNELNANGLDVSLASHLDGYHKLLTQEGITAYNRIIGEVNSYTNKHNQICHKSERIAKLRPLHKQILSDGMGVSFLPSKFADDSEMCQAVNEFYRHYAHVFAKVQSLFDRFDDYQKDGIYVEHKNLNELSKQAFGDFALLGRVLDGYYVDVVNPEFNDKFAKAKTDNAKEKLTKEKDKFIKGVHSLASLEQAIEHYIAGHDDESVQAGKLGQYFKHGLAGVDNPIQKIHNSHSTIKGFLERERPAGERTLPKIKSDKSLEMTQLRQLKELLDNALNVVHFAKLLTTKTTLDNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMVYKLLPGSNKMLPKVFFAKSNLDYYNPSAELLDKYAQGTHKKGDNFNLKDCHALIDFFKASINKHPEWQHFGFEFSLTSSYQDLSDFYREVEPQGYQVKFVDIDADYIDELVEQGQLYLFQIYNKDFSPKAHGKPNLHTLYFKALFSEDNLANPIYKLNGEAEIFYRKASLDMNETTIHRAGEVLENKNPDNPKERQFVYDIIKDKRYTQDKFMLHVPITMNFGVQGMTIKEFNKKVNQSIQQYDEVNVIGIDRGERHLLYLTVINSKGEILEQRSLNDIITTSANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADNEIGSYKNALQLTNNFTDLKSIGKQTGFLFYVPAWNTSKIDPVTGFVDLLKPRYENIAQSQAFFDKFDKICYNADKGYFEFHIDYAKFTDKAKNSRQIWTICSHGDKRYVYDKTANQNKGATIGINVNDELKSLFARYRINDKQPNLVMDICQNNDKEFHKSLTYLLKALLALRYSNASSDEDFILSPVANDKGVFFNSALADDTQPQNADANGAYHIALKGLWLLNELKNSDDLDKVKLAIDNQTWLNFAQNR

SEQ ID NO: 967 - protein, 1257 aa, unidentified
  REGION 1..1257: note = Description of Unknown: Bacteroidales sequence
MKYTDFTGIYPVSKTLRFELIPQGSTVENMKREGILNNDMHRADSYKEMKKLIDEYHKVFIERCLSDFSLKYDDTGKHDSLEEYFFYYEQKRNDKTKKIFEDIQVALRKQISKRFTGDTAFKRLFKKELIKEDLPSFVKNDPVKTELIKEFSDFTTYFQEFHKNRKNMYTSDAKSTAIAYRIINENLPKFIDNINAFHIVAKVPEMQEHFKTIADELRSHLQVGDDIDKMFNLQFFNKVLTQSQLAVYNAVIGGKSEGNKKIQGINEYVNLYNQQHKKARLPMLKLLYKQILSDRVAISWLQDEFDNDQDMLDTIEAFYNKLDSNETGVLGEGKLKQILMGLDGYNLDGVFLRNDLQLSEVSQRLCGGWNIIKDAMISDLKRSVQKKKKETGADFEERVSKLFSAQNSFSIAYINQCLGQAGIRCKIQDYFACLGAKEGENEAETTPDIFDQIAEAYHGAAPILNARPSSHNLAQDIEKVKAIKALLDALKRLQRFVKPLLGRGDEGDKDSFFYGDFMPIWEVLDQLTPLYNKVRNRMTRKPYSQEKIKLNFENSTLLNGWDLNKEHDNTSVILRREGLYYLGIMNKNYNKIFDANNVETIGDCYEKMIYKLLPGPNKMLPKVFFSKSRVQEFSPSKKILEIWESKSFKKGDNFNLDDCHALIDFYKDSIAKHPDWNKFNFKFSDTQSYTNISDFYRDVNQQGYSLSFTKVSVDYVNRMVDEGKLYLFQIYNKDFSPQSKGTPNMHTLYWRMLFDERNLHNVIYKLNGEAEVFYRKASLRCDRPTHPAHQPITCKNENDSKRVCVFDYDIIKNRRYTVDKFMFHVPITINYKCTGSDNINQQVCDYLRSAGDDTHIIGIDRGERNLLYLVIIDQHGTIKEQFSLNEIVNEYKGNTYCTNYHTLLEEKEAGNKKARQDWQTIESIKELKEGYLSQVIHKISMLMQRYHAIVVLEDLNGSFMRSRQKVEKQVYQKFEHMLINKLNYLVNKQYDAAEPGGLLHALQLTSRMDSFKKLGKQSGFLFYIPAWNTSKIDPVTGFVNLFDTRYCNEAKAKEFFEKFDDISYNDERDWFEFSFDYRHFTNKPTGTRTQWTLCTQGTRVRTFRNPEKSNHWDNEEFDLTQAFKDLFNKYGIDIASGLKARIVNGQLTKETSAVKDFYESLLKLLKLTLQMRNSVTGTDIDYLVSPVADKDGIFFDSRTCGSLLPANADANGAFNIARKGLMLLRQIQQSSIDAEKIQLAPIKNEDWLEFAQEKPYL

SEQ ID NO: 968 - protein, 1245 aa, Phocaeicola plebeius
METFSGFTNLYPLSKTLRFRLIPVGETLKYFIGSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGFYSESTDTKLIRDNGSIQKIKLFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 969 - protein, 1245 aa, Phocaeicola plebeius
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVVQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNAYTDVKEAIGFYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDGNCYEKMEYKLLPGANKMLPKVFFSKSRINEFMPNERLLSNYEKGTHKKSGICFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLCSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNALGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 970 - protein, 1245 aa, Phocaeicola plebeius
METFSGFTNLYPLSKTLRFRLIPVGETLKHFIGSGILEEDQHRAESYVKVKAIIDDYHRTYIENSLSGFELPLESTGKFNSLEEYYLYHNIRNKTEEIQNLSSKVRTNLRKQVVTQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLLEKFENDSQVVGAMVNFWNTIHDTVLAEGGLKTIIASLGSYGLEGIFLKNDLQLTDISQKATGSWSKISSEIKQKIEAMNPQKKKESYESYQERIDKLFKSYKSFSLAFVNECLRGEYKIEDYFLKLGAVNSSLLQKENHFSHILNTYTDVKEVIGFYSESTDTKLIQDNDSIQKIKQFLDAVKDLQAYVKPLLGNSDETGKDERFYGDLIEYWSLLDLITPLYNMVRNYVTQKPYSVDKIKINFQNPTLLNGWDLNKEMDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLNKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKANGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYDEFTKKAEGTKTDWTVCSYGNRIITFRNPDKNSQWDNKEINLTENIKLLFERFGIDLSSNLKDEIMERTEKEFFIELISLFKLVLQMRNSWTGTDIDYLVSPVCNENGEFFDSRNVDETLPQNADANGAYNIARKGMILLDKIKKNNGEKKLTLSITNREWLSFAQGCCKNG

SEQ ID NO: 971 - protein, 1261 aa, Moraxella lacunata
MLFQDFTHLYPLSKTVRFELKPIGKTLEHIHAKNFLSQDKTMADMYQKVKAILDDYHRDFIADMMGEVKLTKLAEFCDVYLKFRKNPKDDGLQKQLKDLQAVLRKEIVKPIGNGGKYKVGYDRLFGAKLFKDGKELGDLAKFVIAQESESSPKLPQIAHFEKFSTYFTGFHDNRKNMYSSDDKHTAIAYRLIHENLPRFIDNLQILATIKQKHSALYDQIASELTASGLDVSLASHLGGYHKLLTQEGITAYNRIIGEVNSYTNKHNQICHKSERIAKLRPLHKQILSDGMGVSFLPSKFADDSEMCQAVNEFYRHYADVFAKVQSLFDRFDDYQKDGIYVEHKNLNELSKRAFGDFGFLKRFLEEYYADVIDPEFNEKFAKTEPDSDEQKKLAGEKDKFVKGVHSLASLEQVIEYYTAGYDDESVQADKLGQYFKHRLAGVDNPIQKIHNSHSTIKGFLERERPAGERALPKIKSDKSPEMTQLRQLKELLDNALNVVHFAKLVSTETVLDTRSDKFYGEFRPLYVELAKITTLYNKVRDYLSQKPFSTEKYKLNFGNPTLLNGWDLNKEKDNFGVILQKDGCYYLALLDKAHKKVFDNAPNTGKSVYQKMVYKQIANARRDLACLLIINGKVVRKTKGLDDLREKYLPYDIYKIYQSESYKVLSPNFNHQDLVKYIDYNKILASGYFEYFDFRFKESSEYKSYKEFLDDVDNCGYKISFCNINADYIDELVEQGQLYLFQIYNKDFSPKAHGKPNLHTLYFKALFSEDNLANPIYKLNGEAQIFYRKASLDMNETTIHRAGEVLENKNPDNPKQRQFVYDIIKDKRYTQDKFMLHVPITMNFGVQGMTIEGFNKKVNQSIQQYDDVNVIGIDRGERHLLYLTVINSKGEILEQRSLNDIITTSANGTQMTTPYHKILNKKKEGRLQARKDWGEIETIKELKAGYLSHVVHQISQLMLKYNAIVVLEDLNFGFKRGRLKVENQVYQNFENALIKKLNHLVLKDKTDDEIGSYKNALQLTNNFTDLKSIGKQTGFLFYVPARNTSKIDPETGFVDLLKPRYENITQSQAFFGKFDKICYNTDKGYFEFHIDYAKFTDEAKNSRQTWVICSHGDKRYVYNKTANQNKGATKGINVNDELKSLFACHHINDKQPNLVMDICQNNDKEFHKSLMYLLKALLALRYSNANSDEDFILSPVANDEGVFFNSALADDTQPQNADANGAYHIALKGLWVLEQIKNSDDLDKVDLEIKDDEWRNFAQNR

SEQ ID NO: 972 - protein, 1275 aa, unidentified
  REGION 1..1275: note = Description of Unknown: Lachnospiraceae bacterium sequence
MGKNQNFQEFIGVSPLQKTLRNELIPTETTKKNITQLDLLTEDEIRAQNREKLKEMMDDYYRDVIDSTLHAGIAVDWSYLFSCMRNHLRENSKESKRELERTQDSIRSQIYNKFAERADFKDMFGASIITKLLPTYIKQNPEYSERYDESMEILKLYGKFTTSLTDYFETRKNIFSKEKISSAVGYRIVEENAEIFLQNQNAYDRICKIAGLDLHGLDNEITAYVDGKTLKEVCSDEGFAKAITQEGIDRYNEAIGAVNQYMNLLCQKNKALKPGQFKMKRLHKQILCKGTTSFDIPKKFENDKQVYDAVNSFTEIVMKNNDLKRLLNITQNVNDYDMNKIYVAADAYSTISQFISKKWNLIEECLLDYYSDNLPGKGNAKENKVKKAVKEETYRSVSQLNELIEKYYVEKTGQSVWKVESYISRLAETITLELCHEIENDEKHNLIEDDDKISKIKELLDMYMDAFHIIKVFRVNEVLNFDETFYSEMDEIYQDMQEIVPLYNHVRNYVTQKPYKQEKYRLYFNTPTLANGWSKNKEYDNNAIILMRDDKYYLGILNAKKKPSKQTMAGKEDCLEHAYAKMNYYLLPGANKMLPKVFLSKKGIQDYHPSSYIVEGYNEKKHIKGSKNFDIRFCRDLIDYFKECIKKHPDWNKFNFEFSATETYEDISVFYREVEKQGYRVEWTYINSEDIQKLEEDGQLFLFQIYNKDFAVGSTGKPNLHTLYLKNLFSEENLRDIVLKLNGEAEIFFRKSSVQKPVIHKCGSILVNRTYEITESGTTRVQSIPESEYMELYRYFNSEKQIELSDEAKKYLDKVQCNKAKTDIVKDYRYTMDKFFIHLPITINFKVDKGNNVNAIAQQYIAEQEDLHVIGIDRGERNLIYVSVIDMYGRILEQKSFNLVEQVSSQGTKRYYDYKEKLQNREEERDKARKSWKTIGKIKELKEGYLSSVIHEIAQMVVKYNAIIAMEDLNYGFKRGRFKVERQVYQKFETMLISKLNYLADKSQAVDEPGGILRGYQMTYVPDNIKNVGRQCGIIFYVPAAYTSKIDPTTGFINAFKRDVVSTNDAKENFLMKFDSIQYDIEKGLFKFSFDYKNFATHKLTLAKTKWDVYTNGTRIQNMKVEGHWLSMEVELTTKMKELLDDSHIPYEEGQNILDDLREMKDITTIVNGILEIFWLTVQLRNSRIDNPDYDRIISPVLNNDGEFFDSDEYNSYIDAQKAPLPIDADANGAFCIALKGMYTANQIKENWVEGEKLPADCLKIEHASWLAFMQGERG

SEQ ID NO: 973 - protein, 1261 aa, Moraxella sp.
MNTSLFSSFTRQYPVTKTLRFELKPMGATLGHIQQKGFLHKDEELAKIYKKIKELLDEYHRAFIADTLGDAQLVGLDDFYADYQALKQDSKNSHLKDKLTKTQDNLRKQITKNFEKTPQLKERYKRLFTKELFKAGKDKGDLEKWLINHDSEPNKAEKISWIHQFENFTTYFQGFYENRKNMYSDEVKHTAIAYRLIHENLPRFVDNIQVLSKIKSDYPDLYHELNHLDSRTIDFADFKFDDMLQMDFYHHLLIQSGITAYNTLLGGKVLEGGKKLQGINELINLYGQKHKIKIAKLKPLHKQILSDGQSVSFLPKKFDNDYELCQTVNHFYREYVAIFDELVVLFQKFYDYDKDNIYINHQQLNQLSHELFADFRLLSRALDFYYCQIIDGDFNNKINNAKSQNAKEKLLKEKERYTKSNHSINELQKAINHYASHHEDTEVKVISDYFSATNIRNMIDGIHHHFSTIKGFLEKDNNQGESYLPKQKNSNDVKNLKLFLDGVLRLIHFIKPLALKSDDTLEKEEHFYGEFMPLYDKLVMFTLLYNKVRDYISQKPYNDEKIKLNFGNSTLLNGWDVNKEKDNFGVILCKEGLYYLAILDKSHKKVFDNAPKATSSHTYQKMVYKLLPGPNKMLPKVFFAKSNIGYYQPSAQLLENYEKGTHKKGSNFSLTDCHHLIDFFKSSIAKHPEWKEFGFRFSDTHTYQDLSDFYKEIEPQSYKVKFIDIDADYIDDLVEKGQLYLFQLYNKDFSKQSYGKPNLHTLYFKSLFSDDNLKNPIYKLNGEAEIFYRRASLSVSDTTIHQAGEILTPKNPNNTHNRTLSYDVIKNKRYTTDKFFLHIPITMNFGIENTGFKAFNHQVNTTLKNADKKDVHIIGIDRGERHLLYVSVIDGDGRIVEQRTLNDIVSISNNGMSMSTPYHQILDNREKERLAARTDWGDIKNIKELKAGYLSHVVHEVVQMMLKYNAMIVLEDLNFGFKHGRFKVEKQVYQNFENALIKKLNYLVLKNADNHQLGSVRKALQLTNNFTDIKSIGKQTGFIFYVPAWNTSKIDPTTGFVDLLKPRYENMAQAQSFISRFKKIAYNHQLDYFEFEFDYADFYQKTIDKKRIWTLCTYGDVRYYYDHKTKETKTVNITKELKSLLDKHDLSYQNGHNLVDELANSHDKSLLSGVMYLLKVLLALRYSHAQKNEDFILSPVMNKDGVFFDSRFADDVLPNNADANGAYHIALKGLWVLNQIQSADNMDKIDLSISNEQWLHFTQSR

SEQ ID NO: 974 - protein, 1288 aa, Coprococcus sp.
MVGNKISNSFDSFTGINALSKTLRNELIPSDYTKRHIAESDFIAADTNKNEDQYVAKEMMDDYYRDFISKVLDNLHDIEWKNLFELMHKAKIDKSDATSKELIKIQDMLRKKIGKKFSQDPEYKVMLSAGMITKILPKYILEKYETDREDRLEAIKRFYGFTVYFKEFWASRQNVFSDKAIASSISYRIIHENAKIYMDNLDAYNRIKQIACEEIEKIEEEAYDFLQGDQLDVVYTEEAYGRFISQSGIDLYNNICGVINAHMNLYCQSKKCSRSKFKMQKLHKQILCKAETGFEIPLGFQDDAQVINAINSFNALIKEKNIISRLRTIGKSISLYDVNKIYISSKAFENVSVYIDHKWDVIASSLYKYFSEIVKGNKDNREEKIQKEIKKVKSCSLGDLQRLVNSYYKIDSTCLEHEVTEFVTKIIDEIDNFQITDFKFNDKISLIQNEQIVMDIKTYLDKYMSIYHWMKSFVIDELVDKDMEFYSELDELNEDMSEIVNLYNKVRNYVTQKPYSQEKIKLNFGSPTLADGWSKSKEFDNNAIILIRDEKIYLAIFNPRNKPAKTVISGHDVCNSETDYKKMNYYLLPGASKTLPHVFIKSRLWNESHGIPDEILRGYELGKHLKSSVNFDVEFCWKLIDYYKECISCYPNYKAYNFKFADTESYNDISEFYREVECQGYKIDWTYISSEDVEQLDRDGQIYLFQIYNKDFAPNSKGMDNLHTKYLKNIFSEDNLKNIVIKLNGEAELFYRKSSVKKKVEHKKGTILVNKTYKVEDNTENSKEKRVIIESVPDDCYMELVDYWRNGGIGILSDKAVQYKDKVSHYEATMDIVKDRRYTVDKFFIHLPITINFKADGRININEKVLKYIAENDELHVIGIDRGERNLLYVSVINKKGKIVEQKSFNMIESYETVTNIVRRYNYKDKLVNKESARTDARKNWKEIGKIKEIKEGYLSQVIHEISKMVLKYNAIIVMEDLNYGFKRGRFRVERQVYQKFENMLISKLAYLVDKSRKADEPGGVLRGYQLTYIPDSLEKLGSQCGIIFYVPAAYTSKIDPLTGFVNVFNFREYSNFETKLDFVRSLDSIRYDTEKKLFSISFDYDNFKTHNTTLAKTKWVIYLRGERIKKEHTSYGWKDDVWNVESRIKDLFDSSHMKYDDGHNLIEDILELESSVQKKLINELIEIIRLTVQLRNSKSERYDRTEAEYDRIVSPVMDENGRFYDSENYIFNEETELPKDADANGAYCIALKGLYNVIAIKNNWKEGEKFNRKLLSLNNYNWFDFIQNRRF

SEQ ID NO: 975 - protein, 1288 aa, Coprococcus sp.
MVGNKISNSFDSFTGINALSKTLRNELIPSDYTKRHIAESDFIAADTNKNEDQYVAKEMMDDYYRDFISKVLDNLHDIEWKNLFELMHKAKIDKSDATSKELIKIQDMLRKKIGKKFSQDPEYKVMLSAGMITKILPKYILEKYETDREDRLEAIKRFYGFTVYFKEFWASRQNVFSDKAIASSISYRIIHENAKIYMDNLDAYNRIKQIACEEIEKIEEEAYVFLQGDQLDVVYTEEAYGRFISQSGIDLYNNICGVINAHMNLYCQSKKCSRSKFKMQKLHKQILCKAETGFEIPLGFQDDAQVINAINSFNALIKEKNIISRLRTIGKSISLYDVNKIYISSKAFENVSVYIDHKWDVIASSLYKYFSEIVKGNKDNREEKIQKEIKKVKSCSLGDLQRLVNSYYKIDSTCLEHEVTEFVTKIIDGIDNFQITDFKFNDKISLIQNEQIVMDIKTYLDKYMSIYHWMKSFVIDELVDKDMEFYSELDELNEDMSEIVNLYNKVRNYVTQKPYSQEKIKLNFGSPTLADGWSKSKEFDNNAIILIRDEKIYLAIFNPRNKPAKTVISGHDVCNSETDYKKMNYYLLPGASKTLPHVFIKSRLWNESHGIPDEILRGYELGKHLKSSVNFDVEFCWKLIDYYKECISCYPNYKAYNFKFADTESYNDISEFYREVECQGYKIDWTYISSEDVEQLDRDGQIYLFQIYNKDFAPNSKGMDNLHTKYLKNIFSEDNLKNIVIKLNGEAELFYRKSSVKKKVEHKKGTILVNKTYKVEDNTENSKEKRVIIESVPDDCYMELVDYWRNGGIGILSDKAVQYKDKVSHYEATMDIVKDRRYTVDKFFIHLPITINFKADGRININEKVLKYIAENDELHVIGIDRGERNLLYVSVINKKGKIVEQKSFNMIESYETVTNIVRRYNYKDKLVNKESARTDARKNWKEIGKIKEIKEGYLSQVIHEISKMVLKYNAIIVMEDLNYGFKRGRFRVERQVYQKFENMLISKLAYLVDKSRKADEPGGVLRGYQLTYIPDSLEKLGSQCGIIFYVPAAYTSKIDPLTGFVNVFNFREYSNFETKLDFVRSLDSIRYDTEKRLFSISFDYDNFKTHNTTLAKTKWVIYLRGERIKKEHTSYGWKDDVWNVESRIKDLFDSSHMKYDDGHNLIEDILELESSVQKKLINELIEIIRLTVQLRNSKSERYDRTEAEYDRIVSPVMDEKGRFYDSENYIFNEETELPKDADANGAYCIALKGLYNVIAIKNNWKEGEKFNRKLLSLNNYNWFDFIQNRRF

SEQ ID NO: 976 - protein, 1245 aa, Ruminococcus sp.
MQEHKKISHLTHRNSVQKTIRMQLNPVGKTMDYFQAKQILENDEKLKEDYQKIKEIADRFYRNLNEDVLSKTGLDKLKDYAEIYYHCNTDADRKRLDECASELRKEIVKNFKNRDEYNKLFNKKMIEIVLPQHLKNEDEKEVVASFKNFTTYFTGFFTNRKNMYSDGEESTAIAYRCINENLPKHLDNVKAFEKAISKLSKNAVDDLDTTYSGLCGTNLYDVFTVDYFNFLLPQSGITEYNKIIGGYTTSDGTKVKGINEYINLYNQQVSKRYKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFNESYANEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIRKNGTFKKGDKFSLDDCHKLIDFYKESFKKYPNWLIYNFKFKKTNEYNDISEFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKRASTFPYDLIKDKRYTKWQFSLHFPITMNFKAPDRAMINDDVRNLLKSCNNNFIIGIDRGERNLLYVSIIDSNGAIIYQHSLNIIGNKFKGKTYETNYREKLETREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGMQSGFIFYVRPDFTSKIDPVTGFVNLLYPRYENIDKAKDMISRFDDIRYNAGEDFFEFDIDYDKFPKTASDYRKKWTICTNGERIEAFRNPASNNEWSYRTIILAEKFKELFDNNSINYRDSDNLKAEILSQTKGKFFEDFFKLLRLTLQMRNSNPETGEDRILSPVKDKNGNFYDSSKYDEKSNLPCDADANGAYNIARKGLWIVEQFKKSDNVSTVEPVIHNDKWLKFVQENDMANN

SEQ ID NO: 977 - protein, 1271 aa, Leptospira ryugenii
MKNLANFTNLYSLQKTLRFELKPIGKTLDWIIKKDLLKQDEILAEDYKIVKKIIDRYHKDFIDLAFESAYLQKKSSDSFTAIMEASIQSYSELYFIKEKSDRDKKAMEEISGIMRKEIVECFTGKYSEVVKKKFGNLFKKELIKEDLLNFCEPDELPIIQKFADFTTYFTGFHENRENMYSNEEKATAIANRLIRENLPRYLDNLRIIRSIQGRYKDFGWKDLESNLKRIDKNLQYSDFLTENGFVYTFSQKGIDRYNLILGGQSVESGEKIQGLNELINLYRQKNQLDRRQLPNLKELYKQILSDRTRHSFVPEKFSSDKALLRSLLDFHKEVIQNKNLFEEKQVSLLQAIRETLTDLKSFDLDRIYLTNDTSLTQISNFVFGDWSKVKTILAIYFDENIANPKDRQRQSNSYLKAKENWLKKNYYSIHELNEAISVYGKHSDEELPNTKIEDYFSGLQTKDETKKPIDVLDAIVSKYADLESLLTKEYPEDKNLKSDKGSIEKIKNYLDSIKLLQNFLKPLKPKKVQDEKDLGFYNDLELYLESLESANSLYNKVRNYLTGKEYSDEKIKLNFKNSTLLDGWDENKETSNLSVIFRDTNNYYLGILDKQNNRIFESIPEIQSGEETIQKMVYKLLPGANNMLPKVFFSEKGLLKFNPSDEITSLYSEGRFKKGDKFSINSLHTLIDFYKKSLAVHEDWSVFNFKFDETSHYEDISQFYRQVESQGYKITFKPISKKYIDTLVEDGKLYLFQIYNKDFSQNKKGGGKPNLHTIYFKSLFEKENLKDVIVKLNGQAEVFFRKKSIHYDENITRYGHHSELLKGRFSYPILKDKRFTEDKFQFHFPITLNFKSGEIKQFNARVNSYLKHNKDVKIIGIDRGERHLLYLSLIDQDGKILRQESLNLIKNDQNFKAINYQEKLHKKEIERDQARKSWGSIENIKELKEGYLSQVVHTISKLMVEHNAIVVLEDLNFGFKRGRQKVERQVYQKFEKMLIEKLNFLVFKDKEMDEPGGILKAYQLTDNFVSFEKMGKQTGFVFYVPAWNTSKIDPKTGFVNFLHLNYENVNQAKELIGKFDQIRYNQDRDWFEFQVTTDQFFTKENAPDTRTWIICSTPTKRFYSKRTVNGSVSTIEIDVNQKLKELFNDCNYQDGEDLVDRILEKDSKDFFSKLIAYLRILTSLRQNNGEQGFEERDFILSPVVGSDGKFFNSLDASSQEPKDADANGAYHIALKGLMNLHVINETDDESLGKPSWKISNKDWLNFVWQRPSLKA

SEQ ID NO: 978 - protein, 1245 aa, Ruminococcus sp.
MQEHKKISHLTHRNSVQKTIRMQLNPVGKTMDYFQAKQILENDEKLKENYQKIKEIADRFYRNLNEDVLSKTRLDKLKDYTDIYYHCNTDADRKRLDECASELRKEIVKNFKNRDEYNKLFNKKMIEIVLPKHLKNEDEKEVVTSFKNFTTYFTGFFTNRKNMYSDGEESTAIAYRCINENLPKHLDNVKAFEKAISKLSKNAIDDLDTTYSGLCGTNLYDVFTVDYFNFLLPQSGITEYNKIIGGYTTNDGTKVKGINEYINLYNQQVSKRDKIPNLKILYKQILSESEKVSFIPPKFEDDNELLSAVSEFYANDETFDGMPLKKAIDETKLLFGNLDNPSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYNEAAPLLNENYSNEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIYKSGTFKTGDKFSLDDCHKLIDFYKESFKKYPNWLIYNFKFKKTNEYNDIREFYNDVALQGYNISKMKIPTSFIDKLVDEGKIYLFQLYNKDFSPHSKGTPNLHTLYFKMLFDERNLEDVVYRLNGEAEMFYRPASIKYDKPTHPKNTPIKNKNTLNDKKTSTFPYDLIKDKRYTKWQFSLHFPITMNFKAPDKAMINDDVRNLLKSCNNNFIIGIDRGERNLLYVSVIDSNGAIIYQHSLNIIGNKFKEKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGMQSGFIFYVRPDFTSKIDPVTGFVNLLYPQYENIDKAKDMISRFDEIRYNAGEDFFEFDIDYDEFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDQWLKFVQENDMANN

SEQ ID NO: 979 - protein, 1245 aa, Ruminococcus bromii
MQEHKKISHLTHRNSVQKTIRMQLNPVGKTMDYFQAKQILENDEKLKEDYQKIKEIADRFYRNLNEDVLSKTGLDKLKDYADIYYHCNTDADRKRLNECASELRKEIVKNFKNRDEYNKLFNKKMIEIVLPKHLKNEDEKEVVASFKNFTTYFTGFFTNRKNMYSDGEESTAIAYRCINENLPKHLDNVKVFEKAISKLSKNAIDDLGATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFSENYDNEKGLKNDDKSISLIKNFLDAIKEIEKFIKPLSETNITGEKNDLFYSQFTPLLDNISRIDILYDKVRNYVTQKPFSTDKIKLNFGNSQLLNGWDKDKEREYGAVLLCKDEKYYLAIIDKSNNSILENIDFQDCNESDYYEKIVYKLLTKINGNLPRVFFSEKRKKLLSPSDEILKIYKSGTFKKGDKFSLDDCHKLIDFYKESFKKYPNWLIYNFKFKNTNEYNDISEFYNDVASQGYNISKMKIPTTFIDKLVDEGKIYLFQLYNKDFSPHSKGTPNLHTLYFKMLFDERNLEDVVYKLNGEAEMFYRPASIKYDKPTHPKNTPIKNKNTLNDKKASTFPYDLIKDKRYTKWQFSLHFPITMNFKAPDKAMINDDVRNLLKSCNNNFIIGIDRGERNLLYVSVIDSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDKWLKFVQENDMANN

SEQ ID NO: 980 - protein, 1245 aa, Ruminococcus bromii
MQERKKISHLTHRNSVKKTIRMQLNPVGKTMDYFQAKQILENDEKLKENYQKIKEIADRFYRNLNEDVLSKTGLDKLKDYAEIYYHCNTDADRKRLNKCASELRKEIVKNFKNRDEYNKLFDKRMIEIVLPKHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTNDGTKVKGINEYINLYNQQVSKRDKIPNLQILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIRKKSIVDYYKTSLMQLTDNLSDKYNEAAPLLNENYSNEKGLKNDDKSISLIKNFLDAIKEIEKFIKPLSETNITGEKNDLFYSQFTPLLDNISRIDILYDKVRNYVTQKPFSTDKIKLNFGNYQLLNGWDKDKEREYGAVLLCKDEKYYLAIIDKSNNRILENIDFQDCDESDCYEKIIYKLLPTPNKMLPKVFFAKKHKKLLSPSDEILKIYKNGTFKKGDKFSLDDCHKLIDFYKESFKKYPKWLIYNFKFKKTNGYNDIREFYNDVALQGYNISKMKIPTSFIDKLVDEGKIYLFQLYNKDFSPHSKGTPNLHTLYFKMLFDERNLEDVVYRLNGEAEMFYRPASIKYDKPTHPKNTPIKNKNTLNDKRASTFPYDLIKDKRYTKWQFSLHFPITMNFKDPDKAMINDDVRNLLKSCNNNFIIGIDRGERNLLYVSVINSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYEKIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDKWLKFVQENDMANN

SEQ ID NO: 981 - protein, 1245 aa, Ruminococcus sp.
MQERKKISHLTHRNSVLKTIGMQLNPVGKTMDYFQAKQILENDEKLKEDYQKIKEIADRFYRNLNEDVLSKTGLDKLKDYAEIYYHCNTDADRKRLNKCASELRKEIVKNFKNRDEYNKLFDKRMIEIVLPKHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTSDGTKVKGINEYINLYNQQVSKRDKIPNLQILYKQILSESEKVSFIPPKFEDDNELLSAVSEFYANDETFDEMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENNEIREKSIVDYYKTSLMQLTDNLSDKYNEVAPLLNENYSNEKGLKNDDKSISLIKNFLDAIKEIEKFIKPLSETNITGEKNDLFYSQFTPLLDNISRIDILYDKVRNYVTQKPFSTDKIKLNFGNYQLLNGWDKDKEREYGAVLLCRDEKYYLAIIDKSNNRILENIDFQDCDESDCYEKIIYKLLPTPNKMLPKVFFAKKHKKLLSPSDEILKIRKNGTFKKGDKFSLDDCHKLIDFYKESFKKYPNWLIYNFKFKKTNEYNDIREFYNDVALQGYNISKMKIPTSFIDKLVDEGKIYLFQLYNKDFSPHSKGTPNLHTLYFKMLFDERNLEDVVYKLNGEAKMFYRPASIKYDKPTHPKNTPIKNKNTLNDKKASTFPYDLIKDKRYTKWQFSLHFSITMNFKAPDKAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKSDNVSTVEPVIHNDKWLKFVQENDMANN

SEQ ID NO: 982 - protein, 1278 aa, Ruminococcus sp.
MSININKFSDECRKIDFFTDLYNIQKTLRFSLIPIGATADNFEFKGRLSKEKDLLDSAKRIKEYISKYLADESDICLSQPVKLKHLDEYYELYITKDRDEQKFKSVEEKLRKELADLLKEILKRLNKKILSDYLPEYLEDDEKALEDIANLSSFSTYFNSYYDNCKNMYTDKEQSTAIPYRCINDNLPKFIDNMKAYEKALEELKPSDLEELRNNFKGVYDTTVDDMFTLDYFNCVLSQSGIDSYNAIIGNDKVKGINEYINLHNQTAEQGHKVPNLKRLYKQIGSQKKTISFLPSKFESDNELLKAVYDFYNTGDAEKNFTALKDTITEFEKIFDNLSEYNLDGVFVRNDISLTNLSQSMFNDWSVFRNLWNDQYDKVNNPEKAKDIDKYNDKRHKVYKKSESFSINQLQELIATTLEEDINSKKITDYFSCDFHRVTTEVENKYQLVKDLLSSDYPKNKNLKTSEEDVALIKDFLDSVKSLESFVKILTGTGKESGKDELFYGSFTKWFDQLRYIDKLYDKVRNYITEKPYSLDKIKLSFDNPQFLGGWQHSKETDYSAQLFMKDGLYYLGVMDKETKREFKTQYNTPENDSDTMVKIEYNQIPNPGRVIQNLMLVDGKIVKKNGRKNADGVNAVLEELKNQYLPENINRIRKTESYKTTSNNFNKDDLKAYLEYYIARTKEYYCKYNFVFKSADEYGSFNEFVDDVNNQAYQITKVKVSEKQLLSLVEQGKLYLFKIYNKDFSEYSKGKKNLHTMYFQMLFDDRNLENLVYKLQGGAEMFYRPASIKKDSEFKHDANVEIIKRTCEDKVNDKDNPTDDEKAKYYSKFDYDIVKNKRFTKDQFSLHLTLAMNCNQPDHYWLNNDVRELLKKSNKNHIIGIDRGERNLIYVTIINSDGVIVDQINFNIIENSYNGKKYKTDYQKKLNQREEDRQKARKTWKTIETIKELKDGYISQVVHQICKLIVQYDAIVVMENLNGGFKRGRTKVEKQVYQKFETMLINKLNYYVDKGTDYKECGGLLKAYQLTNKFETFERIGKQSGIIFYVDPYLTSKIDPVTGFANLLYPKYETIPKTHNFISNIDDIRYNQSEDYFEFDIDYDKFPQGSYNYRKKWTICSYGNRIKYYKDSRNKTASVVVDITEKFKETFTNAGIDFVNDNIKEKLLLVNSKELLKSFMDTLKLTVQLRNSEINSDVDYIISPIKDRNGNFYYSENYKKSNNEVPSQPQDGDANGAYNIARKGLMIINKLKKADDVTNNELLKISKKEWLEFAQKGDLGE

SEQ ID NO: 983 - protein, 1562 aa, Leptospira ilyithenensis
MKATSIWDNFTRKYSVSKTLRFELRPVGKTEENIVKKEIIDAEWISGKNIPKGTDADRARDYKIVKKLLNQLHILFINQALSSENVKEFEKEDKKSKTFVAWSDLLATHFDNWIQYTRDKSNSTVLKSLEKSKKDLYSKLGKLLNSKANAWKAEFISYHKIKSPDNIKIRLSASNVQILFGNTSDPIQLLKYQIELDNIKFLKDDGSEYTTKELADLLSTFEKFGTYFSGFNQNRANVYDIDGEISTSIAYRLFNQNIEFFFQNIKRWEQFTSSIGHKEAKENLKLVQWDIQSKLKELDMEIVQPRFNLKFEKLLTPQSFIYLLNQEGIDAFNTVLGGIPAEVKAEKKQGVNELINLTRQKLNEDKRKFPSLQIMYKQIMSERKTNFIDQYEDDVEMLKEIQEFSNDWNEKKKRHSASSKEIKESAIAYIQREFHETFDSLEERATVKEDFYLSEKSIQNLSIDIFGGYNTIHNLWYTEVEGMLKSGERPLTRVEKEKLKKQEYISFAQIERLISKHSQQYLDSTPKEANDRSLFKEKWKKTFKNGFKVSEYTNLKLNELISEGETFQKIDQETGKETTIKIPGLFESYENAILVESIKNQSLGTNKKESVPSIKEYLDSCLRLSKFIESFLVNSKDLKEDQSLDGCSDFQNTLTQWLNEEFDVFILYNKVRNHVTKKPGNTDKIKINFDNATLLDGWDVDKEAANFGFLLKKADNYYLGIADSSFNQDLKYFNEGERLDEIEKNRKNLEKEESKNISKIDQEKVKKYKEVIDDLKAISNLNKGRYSKAFYKQSKFTTLIPKCTTQLNEVIEHFKKFDTDYRIENKKFAKPFIITKEVFLLNNTVYDTATKKFTLKIGEDEDTKGLKKFQIGYYRATDDKKGYESALRNWITFCIEFTKSYKSCLNYNYSSLKSVSEYKSLDEFYKDLNGIGYTIDFVDISEEYINKKINEGKLYLFQIYNKDFSEKSKGKENLHTTYWKLLFDSKNLEDVVIKLNGQAEVFFRPASIHEKEKITHFKNQEIQNKNPNAVKKTSKFEYDIIKDNRFTKNKFLFHCPITLNFKADGNPYVNNEVQENIAKNPNVNIIGIDRGEKHLLYFTVINQQGQILDAGSLNSIKSEYKDKNQQSVSFETPYHKILDKKESERKEARESWQEIENIKELKAGYLSHVVHQLSNLIVKYNAIVVLEDLNKGFKRGRFKVEKQVYQKFEKSLIEKLNYLVFKDRKESNEPGHHLNAYQLTNKFLSFERLGKQSGVLFYATASYTSKVDPVTGFMQNIYDPYHKEKTREFYKNFTKIVYNGNYFEFNYDLNSVKPDSEEKRYRTNWTVCSCVIRSEYDSNSKTQKTYNVNDQLVKLFEDAKIKIENGNDLKSTILEQDDKFIRDLHFYFIAIQKMRVVDSKIEKGEDSNDYIQSPVYPFYCSKEIQPNKKGFYELPSNGDSNGAYNIARKGIVILDKIRLRVQIEKLFEDGTKIDWQKLPNLISKVKDKKLLMTVFEEWAELTHQGEVQQGDLLGKKMSKKGEQFAEFIKGLNVTKEDWEIYTQNEKVVQKQIKTWKLFSNST

SEQ ID NO: 984 - protein, 871 aa, Prevotella sp.
MKAINEYYKQLGAYCREEGKEKDDFFKRIDGAYCAISHLFFGEHGEIAQSDSDVELIQKLLEAYKGLQRFIKPLLGHGDEADKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAISYDDGMYERLDYYQLKSKTLLGNSYVGDYGLDSMNLLSAFKNAAVKFQFEKEVVPKDKENVPKYLKRLKLDYAGFYQILMNDDKVVDAYKIMKQHILATLTSSIRVPAAIELATQKELGIDELIDEIMNLPSKSFGYFPIVTAAIEEANKRENKPLFLFKMSNKDLSYAATASKGLRKGRGTENLHSMYLKALLGMTQSVFDIGSGMVFFRHQTKGLAETTARHKANEFVANKNKLNDKKKSIFGYEIVKNKRFTVDKYLFKLSMNLNYSQPNNNKIDVNSKVREIISNGGIKNIIGIDRGERNLLYLSLIDLKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKGANETGGLLHALQLTSEFKNFKKSEHQNGCLFYIPAWNTSKIDPATGFVNLFNTKYTNAVEAQEFFSKFDEIRYNEEKDWFEFEFDYDKFTQKAHGTRTKWTLCTYGMRLRSFKNSAKQYNWDSEVVALTEEFKRILGEAGIDIHENLKDAICNLEGKSQKYLEPLMQFMKLLLQLRNSKAGTDEDYILSPVADENGIFYDSRSCGDQLPENADANGAYNIARKGLMLIEQIKNAEDLNNVKFDISNKAWLNFAQQKPYKNG

SEQ ID NO: 985 - RNA, 56 nt, synthetic construct
  misc_feature 1..56: note = Description of Artificial Sequence: Synthetic oligonucleotide
  source 1..56: mol_type = other RNA
gtctaaaagaccatatgaatttctactttcgtagatctgatggtccatgtctgtta

SEQ ID NO: 986 - RNA, 56 nt, synthetic construct
  misc_feature 1..56: note = Description of Artificial Sequence: Synthetic oligonucleotide
  source 1..56: mol_type = other RNA
gtctaaaggccttataaaatttctactgtcgtagatctgatggtccatgtctgtta

SEQ ID NO: 987 - RNA, 55 nt, synthetic construct
  misc_feature 1..55: note = Description of Artificial Sequence: Synthetic oligonucleotide
  source 1..55: mol_type = other RNA
gtctatacagacactttaattctactattgtagatctgatggtccatgtctgtta

SEQ ID NO: 988 - RNA, 56 nt, synthetic construct
  misc_feature 1..56: note = Description of Artificial Sequence: Synthetic oligonucleotide
  source 1..56: mol_type = other RNA
gtctgaaagacaagtataatttctactattgtagatctgatggtccatgtctgtta

SEQ ID NO: 989 - RNA, 56 nt, synthetic construct
  misc_feature 1..56: note = Description of Artificial Sequence: Synthetic oligonucleotide
  source 1..56: mol_type = other RNA
ggctataagccttgtataatttctactattgtagatctgatggtccatgtctgtta

SEQ ID NO: 990 - RNA, 56 nt, synthetic construct
  misc_feature 1..56: note = Description of Artificial Sequence: Synthetic oligonucleotide
  source 1..56: mol_type = other RNA
gttgaaactgtaagcggaatgtctacttgggtagatctgatggtccatgtctgtta

SEQ ID NO: 991 - RNA, 56 nt, synthetic construct
  misc_feature 1..56: note = Description of Artificial Sequence: Synthetic oligonucleotide
  source 1..56: mol_type = other RNA
gcatgagaaccatgcatttctaaggtactccaaaacctgatggtccatgtctgtta

SEQ ID NO: 992 - RNA, 55 nt, synthetic construct
  misc_feature 1..55: note = Description of Artificial Sequence: Synthetic oligonucleotide
  source 1..55: mol_type = other RNA
gttgagtaaccttaaataatttctactgttgtagatctgtggtccatgtctgtta

SEQ ID NO: 993 - RNA, 56 nt, synthetic construct
  misc_feature 1..56: note = Description of Artificial Sequence: Synthetic oligonucleotide
  source 1..56: mol_type = other RNA
atctacaacagtagaaatttaagctaaggcttagacctgatggtccatgtctgtta

SEQ ID NO: 994 - RNA, 40 nt, synthetic construct
  misc_feature 1..40: note = Description of Artificial Sequence: Synthetic oligonucleotide
  source 1..40: mol_type = other RNA
taatttctactcttgtagatctgatggtccatgtctgtta

SEQ ID NO: 995 - DNA, 36 bp, synthetic construct
  misc_feature 1..36: note = Description of Artificial Sequence: Synthetic oligonucleotide
  source 1..36: mol_type = other DNA
gtctatatgacaaagtaatttctactatgtgtagat

SEQ ID NO: 996 - DNA, 36 bp, synthetic construct
  misc_feature 1..36: note = Description of Artificial Sequence: Synthetic oligonucleotide
  source 1..36: mol_type = other DNA
gtctaaaggtaccaccaaatttctactgttgtagat

SEQ ID NO: 997 - DNA, 36 bp, synthetic construct
  misc_feature 1..36: note = Description of Artificial Sequence: Synthetic oligonucleotide
  source 1..36: mol_type = other DNA
ggtataaaccatagtaaaatttctgctattgcagat

SEQ ID NO: 998 - DNA, 36 bp, synthetic construct
  misc_feature 1..36: note = Description of Artificial Sequence: Synthetic oligonucleotide
  source 1..36: mol_type = other DNA
gttgaataaccttaaataatttctactgttgtagat

SEQ ID NO: 999 - DNA, 33 bp, synthetic construct
  misc_feature 1..33: note = Description of Artificial Sequence: Synthetic oligonucleotide
  source 1..33: mol_type = other DNA
ctctaagaggcatataaaatttctactgttgta

SEQ ID NO: 1000 - DNA, 36 bp, synthetic construct
  misc_feature 1..36: note = Description of Artificial Sequence: Synthetic oligonucleotide
  source 1..36: mol_type = other DNA
gtttaataaccctatataatttctactattgtagat

SEQ ID NO: 1001 - DNA, 36 bp, synthetic construct
  misc_feature 1..36: note = Description of Artificial Sequence: Synthetic oligonucleotide
  source 1..36: mol_type = other DNA
ggctataatgcctaagtaatttctactattgtagat

SEQ ID NO: 1002 - DNA, 36 bp, synthetic construct
  misc_feature 1..36: note = Description of Artificial Sequence: Synthetic oligonucleotide
  source 1..36: mol_type = other DNA
gtttaatacacctataagatttctacttttgtagat

SEQ ID NO: 1003 - DNA, 36 bp, synthetic construct
  misc_feature 1..36: note = Description of Artificial Sequence: Synthetic oligonucleotide
  source 1..36: mol_type = other DNA
ggctaacagccttttaaatttctactgtgtgtagat

SEQ ID NO: 1004 - DNA, 36 bp, synthetic construct
  misc_feature 1..36: note = Description of Artificial Sequence: Synthetic oligonucleotide
  source 1..36: mol_type = other DNA
gcttagaacctttaaataatttctactattgtagat

SEQ ID NO: 1005 - DNA, 36 bp, synthetic construct
  misc_feature 1..36: note = Description of Artificial Sequence: Synthetic oligonucleotide
  source 1..36: mol_type = other DNA
ggctagtatgcttcaataatttctactattgtagat

SEQ ID NO: 1006 - DNA, 36 bp, synthetic construct
  misc_feature 1..36: note = Description of Artificial Sequence: Synthetic oligonucleotide
  source 1..36: mol_type = other DNA
gtctaacgaccttttaaatttctactgtttgtagat

SEQ ID NO: 1007 - DNA, 37 bp, synthetic construct
  misc_feature 1..37: note = Description of Artificial Sequence: Synthetic oligonucleotide
  source 1..37: mol_type = other DNA
ggctacataaagcctataatttctactatgtgtagat

SEQ ID NO: 1008 - DNA, 36 bp, synthetic construct
  misc_feature 1..36: note = Description of Artificial Sequence: Synthetic oligonucleotide
  source 1..36: mol_type = other DNA
gtctatatgactaagtaatttctactatgtgtagat

SEQ ID NO: 1009 - DNA, 36 bp, synthetic construct
  misc_feature 1..36: note = Description of Artificial Sequence: Synthetic oligonucleotide
  source 1..36: mol_type = other DNA
gtctaacgacctttaaaatttctactatttgtagat

SEQ ID NO: 1010 - DNA, 36 bp, synthetic construct
  misc_feature 1..36: note = Description of Artificial Sequence: Synthetic oligonucleotide
  source 1..36: mol_type = other DNA
gttaagtaacctatagtaatttctactgttgtagat

SEQ ID NO: 1011 - DNA, 36 bp, synthetic construct
  misc_feature 1..36: note = Description of Artificial Sequence: Synthetic oligonucleotide
  source 1..36: mol_type = other DNA
ctctaagagaaggtataaatttctactgttgtagat

SEQ ID NO: 1012 - DNA, 37 bp, synthetic construct
  misc_feature 1..37: note = Description of Artificial Sequence: Synthetic oligonucleotide
  source 1..37: mol_type = other DNA
gtttaataaccctatataatttctactattgtagata

SEQ ID NO: 1013 - DNA, 36 bp, synthetic construct
  misc_feature 1..36: note = Description of Artificial Sequence: Synthetic oligonucleotide
  source 1..36: mol_type = other DNA
gtttaatcaacccttagaatttctactattgtagat

SEQ ID NO: 1014 - DNA, 36 bp, synthetic construct
  misc_feature 1..36: note = Description of Artificial Sequence: Synthetic oligonucleotide
  source 1..36: mol_type = other DNA
ctctaagagaggatataaatttctactgttgtagat

SEQ ID NO: 1015 - protein, 1302 aa, synthetic construct
  REGION 1..1302: note = Description of Artificial Sequence: Synthetic Native Cas12a/Cpf1 [Acidaminococcus massiliensis] sequence
MAAFDKFIHQYQVSKTLRFALIPQGKTLENTKNNVLQEDDERQKNYEKVKPILDRIYKVFAEESLKDCSVDWNDLNACLDAYQKNPSADKRQKVKAAQDALRDEIAGYFTGKQYANGKNKNAVKEKEQAELYKDIFSKKIFDGTVTNNKLPQVNLSAEETELLGCFDKFTTYFVGFYQNRENVFSGEDIATAIPHRIVQDNFPKFRENCRIYQDLIKNEPALKPLLQQAAAAVMAQNPKGIYQPRKSLDDIFVIPFYNHLLLQDDIDYFNQILGGISGAAGQKKIQGLNETINLFMQQHPQEADKLKKKKIRHRFIPLYKQILSDRTSFSFIPEAFSNSQEALDGIETFKKSLKKNDTFGALERLIQNLASLDLKYVYLSNKKVNEISQALYGEWHCIQDVLKQDFSLESLIQINPQNSSNGFLATLTDEGKKRISQCRNVLGNPLPVKLADDQDKAQVKNQLDTLLAAVHYLEWFKADPDLETDPNFTVPFEKIWEELVPLLSLYSKVRNFVTKKPYSTAKFKLNFANPTLADGWDIHKESDNGALLFEKGGLYYLGIMNPKDKPNFKSYQGAEPYYQKMVYRFFPDCSKTIPKCSTQRKDVKKYFEDHPQATSYQIHDSKKEKFRQDFFEIPREIYELNNTTYGTGKSKYKKFQTQYYQKTQDKSGYQKALRKWIDFSKKFLQTYVSTSIFDFKGLRPSKDYQDLGEFYKDVNSRCYRVTFEKIRVQDIHEAVKNGQLYLFQLYNKDFSPKSHGLPNLHTLYWKAVFDPENLKDPIVKLNGQAELFYRPKSNMQIIQHKTGEEIVNKKLKDGTPVPDDIYREISAYVQGKCQGNLSPEAEKWLPSVTIKKAAHDITKDRRFTEDKFFFHVPITLNYQSSGKPTAFNSQVNDFLTEHPETNIIGIDRGERNLIYAVVITPDGKILEQKSFNVIHDFDYHESLSQREKQRVAARQAWTAIGRIKDLKEGYLSLVVHEIAQMMIKYQAVVVLENLNTGFKRVRGGISEKAVYQQFEKMLIEKLNFLVFKDRAINQEGGVLKAYQLTDSFTSFAKLGNQSGFLFYIPSAYTSKIDPGTGFVDPFIWSHVTASEENRNEFLKGFDSLKYDAQSSAFVLHFKMKSNKQFQKNNVEGFMPEWDICFEKNEEKISLQGSKYTAGKRIIFDSKKKQYMECFPQNELMKALQDVGITWNTGNDIWQDVLKQASTDTGFRHRMINLIRSVLQMRSSNGATGEDYINSPVMDLDGRFFDTRAGIRDLPLDADANGAYHIALKGRMVLERIRSQKNTAIKNTDWLYAIQEERN

SEQ ID NO: 1016 - DNA, 3909 bp, synthetic construct
  misc_feature 1..3909: note = Description of Artificial Sequence: Synthetic Native Cas12a/Cpf1 [Acidaminococcus massiliensis] sequence
  source 1..3909: mol_type = other DNA
atggctgcttttgataagtttatccatcagtatcaggtttcgaagaccctgcgttttgctttgattccccaggggaagactcttgaaaacactaaaaataacgttttgcaggaggatgatgaacgtcagaaaaattatgaaaaggtcaaaccgatcctggaccgtatctataaagtatttgcagaggaaagcctaaaagattgttctgtggattggaacgacctgaacgcctgcctggatgcctaccagaaaaatccttccgctgataagcgtcaaaaggtaaaagctgcccaggatgcactccgggatgaaatcgctggctattttaccgggaaacaatatgcgaatggaaaaaataaaaatgcggtgaaggaaaaagaacaggccgaattgtacaaagatatttttagcaaaaaaatttttgatggaaccgtaaccaataataaattgccccaagtaaatctttctgcagaggaaacagagcttctgggctgctttgataaatttaccacttacttcgtcggtttttatcagaacagagagaatgttttttcgggggaagatattgcaacggccattccccatcggatcgtccaggacaattttccaaaattccgggagaattgcagaatctaccaggacctcataaaaaatgaaccggcactgaaacctttgctgcagcaggctgctgctgcagtgatggctcagaaccccaagggaatctatcagccaaggaaatcgttggatgatatttttgtgattccattttataatcatctgttgttacaagatgatattgattatttcaaccagatcttgggaggcatcagcggtgctgcaggacagaaaaaaatccagggcctgaacgaaaccatcaatctattcatgcagcagcatccccaggaagctgacaaattaaagaagaagaagattcgccatcggttcatccctctttacaagcagattttaagcgatcgtaccagcttttcgtttatcccagaggctttttccaattctcaggaagccctggatgggatagaaacctttaaaaaatccttgaaaaagaacgatacctttggcgctttggagcggctcatccaaaatcttgcttctttagacctgaaatatgtttatctttccaataaaaaagtcaatgaaatatcccaggctttgtatggggaatggcattgtatccaggatgtgctgaagcaggatttttccctggaatcgcttatccagataaatccgcaaaattcttccaatggattccttgccactttgaccgatgaaggcaaaaaaagaatctcccagtgcaggaatgtccttgggaatccgttgcctgtcaaattggcggatgaccaggataaagcacaggtcaagaatcagctggatacgctgctggctgctgtccattatctggaatggttcaaagcggatcctgacctggaaaccgatccgaattttacggttccttttgaaaaaatctgggaagagttggttcctttgctgagcctttatagtaaagtacggaattttgtgaccaaaaagccttattctacagcaaaattcaagctgaattttgccaaccccacattggccgatggctgggatatccataaagaatcagataatggagccttgttatttgaaaaaggaggtttgtattatctggggattatgaatcccaaagataaacctaattttaaatcttatcaaggggccgaaccatactatcagaaaatggtttatcggttctttccggactgttccaagacaataccaaaatgttctacccagagaaaagatgtgaaaaaatatttcgaagaccatccccaagccacttcctaccagattcatgattcaaaaaaggaaaaattcagacaagattttttcgagattccccgggaaatctatgaattgaacaatactacgtatggtacggggaaaagtaaatacaagaaattccagacccagtattatcagaagacccaagataaatctggatatcaaaaagcccttcgcaaatggatcgatttttccaaaaaatttttgcagacgtatgtaagtacctcaatttttgatttcaaggggctgcgtcccagcaaggactatcaagatttgggggaattttataaggatgtcaacagcagatgctatcgggtcacttttgaaaaaatcagggtacaagatatccatgaggctgtaaaaaatggccagctgtatctgttccagctgtacaacaaagacttttcccccaaaagccatggtctgcccaatctccataccctttactggaaagcagtttttgaccccgaaaatttaaaggatccgattgtgaaactcaatgggcaggctgaattgttctatcgtcccaagagcaacatgcagattatccagcataaaaccggtgaagagatcgtaaataagaaactgaaggatgggacgccagtccctgatgatatctatcgggaaatctctgcttatgtacaaggcaagtgccagggaaatttatctccggaagctgaaaaatggctgccttcagtgaccattaaaaaggctgcccatgatattaccaaggacagacggtttacggaagacaaattcttcttccatgttcccattaccctgaactaccaaagctcgggcaaaccaactgcctttaattcccaggtcaatgatttcttgacagagcatccagagaccaatatcatcggtatcgatcggggagaaaggaacctgatttatgcggtagttataactcccgatgggaaaatcctggaacaaaaatcctttaatgtgatccatgacttcgattatcatgaaagcttgagccagagagaaaaacagcgggtggcagcccgccaggcatggaccgccattggtcggatcaaagatctgaaagaggggtatctgtctctggtcgtccatgagattgcccagatgatgatcaaataccaggctgtggttgtactggaaaatctcaatacgggatttaaacgtgtccgtggagggatttcagaaaaagccgtctatcagcagtttgaaaagatgctcatagaaaaactgaatttccttgtgttcaaagatcgggccataaatcaggaaggcggggtactgaaagcgtatcagctgacggacagcttcaccagttttgcaaaattagggaatcaaagtggattcctgttctacatcccttccgcttatacatctaagatagatccaggcacgggctttgtagatcctttcatctggagccatgttacagccagtgaggagaatcggaatgaatttctgaaggggttcgacagtttgaagtatgatgcccaatctagtgcttttgtcctgcatttcaagatgaagagcaacaaacagttccaaaagaacaatgtggaaggattcatgcctgaatgggatatctgctttgagaaaaacgaagagaaaatcagtctgcagggaagcaaatatactgccggaaagcggatcattttcgattccaagaaaaaacagtatatggagtgttttccccaaaatgaactgatgaaggccctgcaggatgttggcatcacttggaatacggggaatgatatctggcaggatgtccttaagcaggcgtcgactgatactgggttccggcatcgcatgatcaatctgatccgctccgtgctgcagatgcgcagcagcaatggagcaaccggcgaagattacatcaattcgcccgtcatggatttggatggccgtttcttcgataccagggcgggtatccgggatctgccgctggacgcagacgccaatggggcataccatattgccttaaagggaagaatggtcctggagcggatccgcagtcaaaaaaatacagccatcaaaaatacagattggctgtatgccattcaggaagaaagaaactga

SEQ ID NO: 1017 - DNA, 4098 bp, synthetic construct
  misc_feature 1..4098: note = Description of Artificial Sequence: Synthetic polynucleotide
  source 1..4098: mol_type = other DNA
atgggccaccatcatcatcatcatagcagcggcctggtgccgcgcggcagcggtaccatggcagctttcgataagttcatccaccagtaccaggtttctaaaacactgcgttttgcactgattccacaaggcaagacgctggaaaataccaagaataatgtacttcaggaggacgatgagcgccaaaaaaactacgaaaaggtaaaaccgatcctcgaccgtatctataaggttttcgccgaggagagtctgaaggactgttcagtggattggaacgacctgaatgcttgccttgatgcataccagaagaatccaagcgcagacaaacggcaaaaggtgaaggctgcccaggatgcgcttcgtgatgagatcgctgggtatttcactgggaagcaatacgctaacggtaagaataagaacgcggtgaaggaaaaggagcaagcagaactctacaaagacatctttagtaagaaaatcttcgacgggacggttacaaacaacaaactgccacaggtgaacttatccgccgaagaaaccgaattgttgggttgttttgacaaatttactacgtacttcgttgggttctatcaaaatcgtgaaaatgttttctctggcgaggacattgctacagcgattccgcaccgcatcgttcaggataatttcccgaagttccgggagaactgtcggatctaccaggatcttattaaaaacgagccagcactgaagccacttttacagcaagctgcagcggcagttatggcgcaaaaccctaaagggatctaccagccacgcaaaagcttggatgatattttcgttatcccattttacaaccacctgttactccaagatgacatcgattacttcaatcagattttaggcgggatctcaggtgcagcaggtcagaagaaaattcagggcttaaacgagaccattaatctgtttatgcaacagcacccgcaggaagccgacaagcttaaaaaaaaaaagattcgccatcgcttcattcctttatacaagcaaatcttgagcgatcgcacctctttctcctttatccctgaagccttttcaaactctcaggaggcgttggacgggatcgagacctttaaaaaaagtttgaaaaagaatgacaccttcggggctcttgaacgtttaattcagaacctcgcatcgctggacttgaagtatgtttatttgagtaataaaaaagtaaacgagatctctcaagctttgtacggcgagtggcactgtatccaagatgttttgaaacaagacttcagtcttgaaagccttatccaaattaatccacaaaattcttccaacgggtttcttgcgactctgaccgacgagggtaagaagcggatcagccaatgccgcaacgttctcggcaaccctctccctgtaaaactggccgacgatcaagacaaagcgcaggtcaaaaaccagttggacactttacttgcggccgttcactatttggagtggttcaaggccgacccagacttggagactgaccctaatttcacagtcccttttgagaagatttgggaagaactggttcctctcttaagcttgtacagtaaggttcgcaatttcgttaccaaaaaaccatactcgacagcgaagtttaagttaaattttgcaaacccgactctcgccgacggttgggacatccataaggaatccgataacggcgcgcttctctttgagaagggtggcttgtattatttaggtatcatgaatcctaaggataagcctaacttcaagtcgtaccaaggcgcagaaccgtattatcaaaaaatggtatatcggttcttcccagattgcagtaagaccattccaaaatgctcaacccagcgtaaagatgtaaaaaaatactttgaagaccatcctcaggcgacctcttaccaaattcacgactcgaagaaggaaaagtttcggcaagacttctttgaaattccgcgcgaaatctatgagctgaacaataccacctacggtaccgggaagagtaagtacaagaagtttcaaacccaatattaccaaaaaacacaagacaagagcgggtatcagaaggccttgcgtaaatggattgacttttcaaaaaagttcctgcagacttacgttagcaccagcattttcgactttaaaggcttgcgtccgtctaaagactaccaagatttaggggagttttataaagatgttaactcacgttgttaccgcgtaactttcgagaagatccgggttcaggacatccatgaagcggttaagaatggccaactctatttattccaactctacaacaaagatttttctccaaaatcgcatgggttacctaaccttcacaccctctactggaaagctgtgtttgaccctgagaatctgaaggatcctatcgtgaaactgaatgggcaggccgaactcttttaccgtccgaaatcgaacatgcaaatcattcaacacaagacgggcgaggagattgttaataaaaagcttaaggacggtactccggttccagatgacatctaccgcgagatctctgcctacgtacagggtaagtgccaaggtaacctgagtccagaagcggaaaagtggttaccatctgtcacaatcaagaaagcagctcatgacattactaaggatcggcggtttacggaggataagttttttttccatgtaccgatcacactgaattatcagagctcagggaagccgacggcgtttaattctcaagtcaatgattttctcacggagcatccagaaaccaatattatcgggatcgatcggggggagcggaacctcatctatgcggtagttatcacgcctgatggtaagattctcgaacaaaaatcttttaacgtaatccacgactttgactatcacgagagtttatcccaacgcgagaagcagcgtgttgcagcacgccaagcttggacagcaattggtcgtattaaagacctgaaggaggggtacctcagccttgtggtccatgagatcgcacagatgatgattaagtatcaagcggtagtggtgctcgaaaatttgaatacgggctttaaacgggtgcggggtgggatctcggagaaggccgtgtatcagcagtttgaaaagatgctcatcgaaaagctgaacttccttgttttcaaggaccgtgccattaatcaagaagggggcgtccttaaggcatatcagctgacagattcgttcacctcatttgcgaaactggggaaccagtccgggtttttgttttacatccctagcgcttatacgagtaaaattgaccctggtactgggttcgtggacccgtttatttggtcgcatgtaacggcgtcggaggagaaccgtaacgaatttctcaaagggttcgatagtctcaagtacgatgcccaatcgtcggccttcgttctgcatttcaaaatgaagtcgaataaacagttccaaaagaacaatgtggaaggctttatgccggaatgggacatttgcttcgaaaagaacgaagaaaagatttcgttacagggcagcaagtataccgctggcaaacgcattatctttgactcgaaaaaaaaacagtacatggaatgctttcctcaaaacgaactgatgaaggcgttgcaagacgtagggatcacatggaatactggtaatgatatttggcaggacgtactgaagcaggcctcgaccgataccgggtttcgtcaccgcatgattaatttaattcggagtgttttacagatgcggtcttctaacggcgcaactggtgaggattatattaacagcccagtcatggacctcgacggtcgttttttcgacacacgggcgggtattcgtgacctgccgttagacgccgatgctaatggggcttaccacattgcgttaaaaggtcgcatggtccttgagcgtattcgctcccagaaaaacactgcgatcaagaacacagactggctgtatgcgatccaggaggagcgtaacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1018 - DNA, 4098 bp, synthetic construct
  misc_feature 1..4098: note = Description of Artificial Sequence: Synthetic polynucleotide
  source 1..4098: mol_type = other DNA
atgggccaccatcatcatcatcatagcagcggcctggtgccgcgcggcagcggtaccatggcggccttcgataagtttattcatcagtaccaagtgtcgaagacgttacgcttcgcgctcatcccacagggtaaaaccctcgaaaacacgaagaacaacgtgctccaagaagatgatgagcgtcaaaaaaattatgaaaaagtaaagcctattctggatcgcatttacaaagtgttcgctgaagagtcccttaaagactgcagcgtagactggaacgatctgaatgcatgcctggatgcctaccaaaagaacccgtcagctgacaaacgccaaaaggtaaaagcagcacaggatgcgttgcgggatgaaatcgcagggtacttcacaggtaaacagtatgccaatggcaaaaacaagaatgcggttaaagagaaggaacaagcggagttatacaaggacatcttttccaagaagatttttgatgggacagtcacaaacaacaaattgccgcaagtgaacctgtcggcagaagaaacagaacttttgggttgcttcgacaaatttaccacgtattttgtaggcttctatcagaatcgggaaaacgttttctcgggggaagacatcgcaacagctatccctcatcgtatcgttcaagacaattttccaaaatttcgggagaattgtcgcatctatcaagacttaattaagaatgaaccagccttaaaaccattgttacaacaggcagcagctgctgtaatggcccagaacccgaagggcatttatcagcctcgtaagagccttgatgacatttttgttatcccattctataaccacttactgttgcaagatgatattgattattttaatcagattttagggggtatttcgggtgcggctggtcaaaagaagatccagggtcttaacgagaccattaatttgtttatgcagcagcatccacaggaggcagacaaactcaagaaaaaaaaaattcgtcaccgctttattccactctacaagcaaatcttgtctgatcgtacctcgttctccttcattccggaagcattcagtaactctcaagaggcgttagacggcatcgaaacctttaaaaaatctctcaagaagaacgatacattcggggcactcgagcggttaattcagaacttagcctccttggatttaaaatatgtgtacttgtccaataagaaggtcaatgaaattagtcaggctctgtacggtgagtggcactgcatccaggacgtgttaaagcaagattttagtctggaatctttaatccagatcaacccacaaaatagttcgaacgggtttttagccacccttactgatgaaggcaaaaagcgtatctcccagtgccgtaatgtattgggcaacccattgccggttaagctcgcggatgatcaagataaagcacaagtcaaaaatcaacttgacacgcttttggcggccgtacattacctcgaatggttcaaggcggaccctgatttagagactgatcctaatttcaccgttccgtttgaaaaaatttgggaagaattagtcccgctgctgagcttatattctaaggttcgtaattttgtgactaaaaagccgtatagtactgcaaagttcaaactcaactttgccaatccaaccttagcagatgggtgggatatccataaagaaagtgataacggggctttgctttttgaaaagggcgggctttattatctgggcattatgaatccgaaggacaagcctaacttcaagagctatcagggcgccgaaccgtattatcagaagatggtttatcggttcttcccagactgcagtaagaccattccaaagtgctccactcaacggaaagacgtgaaaaaatacttcgaagaccacccgcaagctacttcgtaccaaatccatgacagtaaaaaagaaaaatttcggcaagatttcttcgagattccgcgggagatttatgagcttaataataccacttatggcaccgggaaaagtaagtacaaaaaattccaaacgcaatactatcaaaaaacccaagataagagtgggtaccagaaagccctgcgtaagtggattgacttttcgaagaaattcctgcagacttatgtgtccacaagtatcttcgactttaaaggcttacgtccatctaaagattaccaggatcttggggaattttacaaagatgtcaatagtcgttgctatcgtgttacgttcgagaagatccgggtccaggacattcacgaagctgtcaaaaatgggcaactgtacttattccaactttacaataaggatttctctcctaaatcacatggcctcccaaacttacacacgctctactggaaagcggtcttcgacccagagaatttgaaggacccaattgtaaaattgaacggccaggcggaattattttaccgtcctaagtcaaatatgcaaatcatccaacacaagactggcgaggaaatcgtcaacaaaaaattaaaagacgggacgcctgtgccggacgacatctaccgggaaatctcagcatacgtacagggcaagtgtcagggcaacctctcgccggaagcagagaaatggcttccaagcgtgaccatcaaaaaggcggctcacgatattactaaggatcgccggtttaccgaagacaaatttttcttccatgtacctatcaccctgaactatcaatcgtccggtaagccgacagcattcaatagccaggtcaatgatttccttacagagcacccagaaaccaacatcattggtattgaccgtggggagcgtaacctgatctacgcagtagtgattactccggatggcaaaattcttgagcagaagagcttcaacgtcattcatgattttgactatcacgagagcttgtcgcaacgtgaaaagcagcgcgtggcagcacggcaggcatggaccgcgatcggtcgtatcaaggatctcaaagagggttacttatcgctcgtcgtccatgaaattgcacaaatgatgatcaaatatcaagcggtcgttgttctcgagaatctcaacacgggcttcaagcgcgtgcgtggcgggatctccgagaaggccgtataccagcaattcgagaagatgttgatcgaaaagcttaattttcttgtctttaaggaccgtgctatcaatcaggaaggtggggtgctcaaagcgtatcagttgacagatagtttcacaagtttcgctaaattaggtaatcagagcgggtttctcttctatatcccgagcgcctatacgtcgaagatcgacccgggtacgggtttcgtggatccgttcatttggtcacacgttactgctagcgaggagaatcggaacgaatttttaaaagggtttgattcgttaaagtacgatgctcagagctccgcgttcgttcttcatttcaagatgaaatctaacaaacagttccaaaaaaacaacgttgaaggcttcatgccagagtgggacatctgcttcgaaaaaaacgaagaaaaaatctccttacagggttctaagtatacggcggggaagcgcattatttttgactccaagaaaaagcagtatatggaatgtttccctcagaatgaactgatgaaggcactgcaggacgtaggtattacatggaacactggcaacgacatttggcaggatgtcctgaaacaagcatctacggacactgggtttcggcaccggatgattaacttaattcgctccgtgttgcaaatgcggtcgtcaaatggcgctaccggcgaagactatattaacagtccagtcatggacctggacggtcgtttcttcgatacacgtgctggtattcgtgacctccctcttgatgccgatgccaatggcgcatatcatattgctcttaaagggcgtatggttctggagcgtattcgttcgcaaaagaataccgcaattaaaaatactgattggctgtatgctatccaagaggagcgcaacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1019 - DNA, 4098 bp, synthetic construct
  misc_feature 1..4098: note = Description of Artificial Sequence: Synthetic polynucleotide
  source 1..4098: mol_type = other DNA
atgggccaccatcatcatcatcatagcagcggcctggtgccgcgcggcagcggtaccatggctgcgttcgataagtttatccaccaataccaggtaagtaaaacactgcgtttcgcacttattccgcagggtaagacacttgaaaacacaaagaacaacgtgttacaagaggacgacgaacgtcaaaagaactacgagaaagtaaagcctattctcgatcgtatctacaaggttttcgctgaggagtcccttaaggactgctcggtagattggaacgacttgaatgcctgtttagacgcgtaccaaaaaaatccaagcgcagacaagcggcagaaagtgaaagcagctcaggacgcgttgcgtgacgaaatcgccggttacttcaccggcaaacagtacgccaatgggaaaaacaaaaacgcggtgaaggagaaggagcaagcagagttatataaggatattttctccaagaagatctttgatgggacagttacaaataacaagctgcctcaagttaatttgagcgcggaagaaactgaattattaggctgtttcgataagtttacgacgtattttgtaggtttctatcagaatcgcgagaatgtgttttccggggaggacattgccactgcaattccacatcgtatcgtccaggacaacttccctaaattccgggagaactgtcgtatctaccaagatcttattaaaaacgaacctgctttgaaacctcttcttcaacaagccgctgcggcagtgatggcccagaatccgaaggggatctatcaacctcgtaagtcattggacgatattttcgtgattcctttttataaccatcttctgctgcaggatgatattgactacttcaaccaaattctgggtgggattagtggggccgctgggcagaaaaaaatccaaggtcttaacgaaaccattaacctgttcatgcagcaacatccgcaggaagcagacaaacttaagaagaaaaaaatccgtcaccgtttcatccctctttataagcaaatccttagtgaccgtactagcttctcatttatcccagaagcattctccaatagccaagaagcattggacggcatcgagacgtttaaaaaaagcttaaagaaaaatgatacctttggggccttagaacgtcttattcaaaatctcgcgtcattggacctcaagtatgtttatttgagcaataaaaaggttaacgaaatttcccaagcgctctatggcgaatggcactgtatccaagacgtcttaaagcaggatttctcgcttgagagcctgatccaaattaatccgcaaaactcctccaatggcttcttagccactctgacggatgaaggtaagaagcgtattagccaatgtcgcaacgtattggggaacccgcttccagttaaattggctgacgatcaagacaaagctcaggtaaagaaccaactcgacactttactggccgcagttcattacctcgagtggttcaaagctgatccagaccttgaaacagatcctaatttcacagtaccgttcgagaaaatttgggaggaactggtccctctgttatccctttacagcaaagtgcgtaatttcgtcacgaagaagccatacagtactgcgaaattcaagctgaactttgccaacccaacgttggcagacgggtgggatatccataaagagtcagacaatggggcgcttttattcgaaaagggggggttatactatttagggatcatgaaccctaaggataaacctaatttcaagtcataccaaggtgcggagccgtactaccaaaaaatggtctaccgcttctttccagattgcagtaagacgattcctaaatgtagcacccaacgcaaggacgtaaagaagtactttgaggaccatccacaagctacttcgtatcagatccatgactcgaaaaaggaaaaatttcggcaagacttttttgagatccctcgcgagatctacgagctgaataacactacatacggtacgggtaagagcaagtataagaagttccaaacccaatattatcagaagacccaagataagtcgggctatcagaaggcgctgcgcaagtggattgacttttccaagaaattcttacagacttatgtaagcacctctattttcgattttaaagggctgcgtccgagtaaagactatcaggacttgggcgaattctacaaagatgtcaattctcggtgttatcgtgtaacgtttgaaaagatccgtgtacaggacattcatgaagcggttaagaacgggcaactctatctcttccagctctataacaaggacttctctccgaagtcacatgggttgccaaatcttcacacgctgtactggaaagctgtgtttgacccggaaaacctcaaagatcctatcgtcaagctcaacgggcaagctgaattattttaccgcccaaagagtaatatgcagatcattcagcataaaactggtgaagagatcgtcaataagaaattgaaggatgggaccccggttccagacgatatctaccgtgaaattagcgcatacgtgcagggtaagtgccagggcaatttatcaccggaagccgaaaaatggctgccttcagtcacaattaagaaagcagctcacgacattacgaaggatcggcgctttacagaggacaaattcttctttcacgttccaattacattaaattaccagtcctcgggcaagccaacggcattcaactctcaggtaaatgatttcttaacggaacacccggaaactaacatcatcgggattgaccgtggggaacgtaacctgatctatgcagttgtcattacccctgatggcaaaattttagaacaaaagagttttaatgtcatccatgattttgactaccatgagtctctctctcaacgcgaaaaacagcgggtggcagcgcggcaggcgtggacagcaattgggcggatcaaagacctgaaggaagggtacttaagtctcgtggtgcatgagatcgcgcaaatgatgattaagtatcaagccgtcgttgtgctcgaaaatttaaataccgggtttaagcgggttcggggtggtatttctgagaaagctgtgtatcaacaattcgagaaaatgctcattgagaagttgaacttcttggtttttaaagaccgggccattaaccaagaggggggcgtcctcaaggcttatcaattgactgactcttttacatcgttcgccaaacttgggaatcaatcaggcttcttgttctatatcccttcagcgtatacctccaagatcgacccaggcactggtttcgtagaccctttcatttggagtcacgttacagcaagtgaggaaaatcggaatgaatttcttaaagggttcgattcgctgaaatacgatgctcaatcgtctgccttcgtcctgcactttaagatgaagtctaataaacaattccaaaaaaataatgtggagggttttatgcctgaatgggatatttgtttcgagaaaaacgaggagaaaatctctcttcaaggtagtaaatatactgctggtaaacggattattttcgactccaaaaaaaagcaatacatggaatgcttcccgcaaaacgagcttatgaaagctctccaggatgtgggcattacatggaacacagggaatgacatctggcaggacgtattaaaacaagcttccacggatactgggtttcggcaccggatgattaatttgattcgttctgtccttcagatgcgcagcagtaacggcgcaaccggtgaagactacatcaactccccagtaatggacctggatggtcgtttttttgatacccgcgccggcattcgcgacttgccactcgacgcggatgcaaatggcgcctaccacatcgccttaaagggccgtatggtgcttgagcggatccgcagccaaaagaatacagccatcaagaatactgattggctctacgctattcaagaagaacggaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1020 - DNA, 4098 bp, synthetic construct
  misc_feature 1..4098: note = Description of Artificial Sequence: Synthetic polynucleotide
  source 1..4098: mol_type = other DNA
atgggccaccatcatcatcatcatagcagcggcctggtgccgcgcggcagcggtaccatggcagcatttgataagtttattcatcagtaccaagtcagtaaaacgcttcggttcgcactcattccacaaggtaaaacactcgagaacactaaaaacaatgtgttacaggaggacgacgagcggcaaaagaattacgaaaaagtgaagccgatcttagaccgcatctataaggtattcgcagaagaatccttgaaagattgctcggtcgactggaatgacctcaacgcttgtttagacgcctaccaaaaaaacccttcagcggacaaacgccaaaaagtgaaggcagcacaagatgcgttacgggatgagatcgcgggttacttcacgggcaaacagtatgccaatgggaaaaataaaaatgcggttaaggaaaaagagcaggctgaattgtacaaagacattttcagtaagaagatctttgatggcactgttactaataataagctccctcaggtaaatttaagtgccgaagaaaccgaattgctcgggtgctttgataagttcacaacatacttcgtcgggttttaccaaaatcgtgagaacgtctttagtggcgaggatatcgctaccgcgatcccacatcgcattgttcaagataacttcccaaagttccgggagaattgccgtatttaccaggacttgattaagaacgaacctgccctcaagccactccttcagcaggcggctgcagcagttatggcgcagaaccctaaaggtatttaccagccacgtaagtcattggatgatattttcgtaatccctttctacaaccatctgcttttacaagatgacatcgattactttaaccaaatcttagggggtatctctggtgcggctgggcaaaaaaagatccaagggctcaatgaaactatcaacctgttcatgcaacaacaccctcaggaagctgataagttaaaaaagaaaaaaattcgccaccgctttattccactgtacaagcagatcttgtcggatcgtacaagtttttctttcatcccagaagcattctcaaacagccaggaggctctcgatgggattgaaacattcaagaagtccttgaagaagaacgacacttttggcgcccttgagcgtttaatccaaaatttagcaagcctcgatttaaaatatgtatatttgtcaaataaaaaggtcaatgagatttcccaagcactttatggggagtggcactgcattcaagatgtactgaaacaggatttctccctcgagagtctgatccagattaacccacagaactcgtctaatgggtttctcgcaacacttaccgacgaagggaaaaaacgcattagtcaatgtcgcaatgtgttaggcaatccactgcctgtcaaattggcagacgatcaggacaaggcacaagttaagaaccaacttgatactctcctcgccgcggttcactacttagaatggttcaaggctgatcctgacttagaaactgacccgaatttcacggtgccattcgaaaagatttgggaggagcttgtaccactcttgtctttatattcaaaagtacggaatttcgttactaagaaaccatatagtaccgccaagttcaagcttaactttgctaacccaacgctcgctgatggttgggatattcataaggaaagtgacaatggggcattattatttgagaaaggcggtctctactacctcggtatcatgaacccgaaagataaaccaaactttaaaagttatcaaggcgcagagccttactatcaaaaaatggtgtaccggttttttccggattgttccaaaactatccctaaatgcagcactcaacgtaaggatgtgaagaaatattttgaggaccaccctcaggccacttcataccagattcatgattcgaagaaagagaagttccgccaggacttcttcgaaatcccacgtgaaatctatgaacttaacaatacgacctacggcacggggaagagtaagtacaaaaagtttcagacacaatactaccagaagacccaggacaagtccgggtatcaaaaggctcttcgcaaatggattgatttctccaaaaaattcttgcaaacctacgtaagcacgagtattttcgacttcaaaggcctgcgtccgagtaaagactatcaagacctcggcgaattctacaaggacgtaaattctcgctgttaccgtgtcacattcgaaaaaattcgcgtgcaggatatccatgaggcagttaagaacggtcaactctatctcttccagttatacaacaaggatttttcaccaaagtcccacggtttaccaaacttacacactctctactggaaggcagtgttcgatccagagaatcttaaagacccgatcgttaaactcaatgggcaggccgaattattttatcgtccaaagtccaatatgcaaattattcagcataaaacgggtgaggagattgtgaacaaaaagttaaaggacggtacaccggtaccagatgacatttatcgcgagatcagcgcttatgtacaagggaaatgccaggggaatctgtcaccagaggcggagaagtggctgccatctgtgacgatcaagaaagcagctcatgatattactaaagatcgtcgcttcacagaggacaagttcttcttccatgtaccgattactctgaactaccaatcgtctgggaagccgactgcctttaatagtcaagtaaacgactttttgaccgaacaccctgagacaaatattatcggtattgatcgcggcgagcgtaacctcatctacgctgttgttattaccccggacggcaagatcctcgaacaaaaatctttcaacgtaattcatgactttgactaccacgaatcgctgtctcagcgcgagaagcagcgtgtcgctgctcgtcaggcgtggacggctatcgggcgtattaaggacctgaaggagggttatttatctctcgtcgtgcacgagatcgctcaaatgatgatcaagtaccaggcagttgtagttttagagaatcttaacactgggtttaagcgcgtccgcggcgggatcagcgaaaaagccgtttaccagcaatttgagaaaatgctcatcgagaaattgaactttctcgtctttaaggaccgtgctattaaccaagaagggggcgtactcaaggcttatcagttgacagatagttttaccagtttcgccaaactcgggaatcagagcggctttttattttacatcccaagcgcatatacaagcaaaatcgatcctgggacaggctttgttgacccgtttatctggtcccacgtaaccgcatcagaagaaaaccgtaatgaattcttgaagggttttgatagccttaaatatgatgcacaaagcagcgcgttcgttcttcatttcaaaatgaagtcgaataaacagttccagaaaaacaacgttgaagggttcatgccggaatgggacatttgtttcgaaaaaaacgaggaaaaaatttctttgcaaggttcgaaatataccgctggcaaacggatcatctttgattcaaaaaaaaagcagtacatggaatgctttccgcaaaatgagttgatgaaggcactgcaggacgtcggtattacgtggaatacgggtaatgacatctggcaagacgtcctcaagcaggcaagtacggatacagggtttcggcatcggatgattaatttaatccggagtgtccttcaaatgcggagttctaatggggccactggcgaagactacattaatagtcctgttatggacctcgacggccggttctttgacacgcgcgccggcattcgcgacctgccacttgacgctgatgcgaacggggcatatcatattgcgctgaaagggcgtatggtattggagcgtatccggtcgcagaaaaataccgcgatcaagaataccgactggctttatgccatccaggaagagcggaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1021 - DNA, 4098 bp, synthetic construct
  misc_feature 1..4098: note = Description of Artificial Sequence: Synthetic polynucleotide
  source 1..4098: mol_type = other DNA
atgggccaccatcatcatcatcatagcagcggcctggtgccgcgcggcagcggtaccatggctgccttcgataaatttattcaccaatatcaggttagcaaaacgctccgctttgcccttattccgcagggtaagactctggagaacaccaagaacaacgtcctgcaagaagacgacgaacgccaaaaaaactatgaaaaagttaagcctatccttgatcgcatctacaaagtattcgccgaagaaagccttaaggattgttcggtggactggaacgacttgaacgcatgcttggatgcctaccaaaaaaacccgtcagcagacaaacgtcagaaagtaaaagcagctcaagatgcgcttcgtgacgaaattgccggttattttacgggcaaacaatacgcaaacgggaaaaataagaacgccgtgaaagagaaagagcaagcggagctctacaaggatattttctccaaaaagatcttcgatggtaccgtaaccaacaacaaattacctcaagtcaacttaagtgccgaggagaccgagttactgggttgttttgacaagtttactacctattttgttgggttttaccagaatcgtgagaacgtcttctccggcgaagatatcgctacggcgatccctcatcgcattgtgcaggacaatttccctaagttccgggaaaattgtcgcatctatcaggatttgatcaagaatgagccagcactcaaaccgttacttcagcaggccgcagctgctgtcatggcgcaaaacccgaaagggatttatcagccgcgtaagtccttagacgatattttcgttatcccgttctataaccatttattgctccaagatgatatcgactactttaatcaaatcttggggggtatcagtggggcagcaggccagaagaagattcagggcttaaacgagacgattaacctcttcatgcagcagcacccacaggaggccgataagttaaaaaagaagaaaattcgtcatcgttttattcctctgtacaaacaaattttgtctgatcgtacatccttcagctttattcctgaggccttttccaactcacaagaggcccttgatggtatcgagacgtttaagaaatcgttaaagaaaaacgacacttttggcgcactcgagcgtttgatccaaaatctggcgagtttggatctgaagtatgtttatctttcgaacaaaaaagttaacgagatcagtcaagcattatatggtgagtggcactgtattcaagacgtgttgaaacaggatttcagcttagaatcattaattcaaatcaatccgcagaactcctcgaatggctttttagccacgctcactgacgagggtaagaagcgtatctctcagtgccgcaacgtactgggtaacccgctgccggtcaaactcgcagatgaccaggataaggctcaagtaaagaatcagttagatacgttacttgccgctgtacattatttagagtggtttaaggcagatccggatcttgaaaccgatccaaattttaccgtgccttttgaaaaaatttgggaggaattagtcccgcttctttctctctactctaaggtgcgcaattttgtcacgaagaaaccgtatagcacagcgaagtttaagctgaacttcgcgaaccctactcttgcggacggctgggatatccataaggagtccgataacggcgccctcctttttgaaaaaggcgggttatattatttagggatcatgaacccaaaagataaaccgaattttaaatcttatcaaggggcagaaccatactatcaaaagatggtctaccgtttctttcctgactgctctaagaccattccaaagtgctctacacaacggaaagacgtcaagaagtattttgaagatcaccctcaggcgacatcctatcaaatccacgatagcaaaaaggagaagtttcgtcaggacttcttcgagatccctcgcgagatttacgagctgaacaacacgacctacggtaccggcaagtctaagtataaaaaattccaaactcaatactaccaaaaaactcaagataagtcgggctaccagaaagcacttcgtaaatggattgacttctcgaagaaatttttgcaaacatacgtctcgacgagcattttcgattttaagggcttacgcccgagtaaagattaccaggatctgggggaattttacaaggatgtaaacagtcggtgctatcgtgttactttcgaaaagattcgggtacaggacattcacgaggctgtaaagaatggtcaattatacctctttcaattatataataaagatttctctcctaagtcccacggtttgcctaacttgcacaccctttattggaaagcggtgttcgacccagagaatctcaaggacccgatcgtaaagcttaatgggcaggcggagctgttttatcgcccaaaaagtaatatgcagatcattcagcataaaaccggtgaagaaatcgtgaacaagaaattgaaagacggcactccggtcccagatgacatttaccgcgagattagtgcgtatgtacaggggaaatgtcaaggtaacctgagtcctgaagcagaaaaatggcttccgtcggtgacaatcaagaaagcggcgcatgatatcacaaaggaccggcgctttactgaagataagtttttcttccatgtgccaatcacgcttaactatcaaagcagcggcaaaccgacggcatttaactcgcaggtaaatgacttcttaacggaacatcctgagactaacattattggtatcgaccgcggggaacgtaacctgatctacgcagtggtaattactccggatgggaagatcctcgagcaaaaaagcttcaatgttatccacgatttcgactaccacgaatcactctcacaacgcgaaaagcagcgggtggccgcgcgccaggcatggacggcaatcggccggatcaaggacctgaaggaaggctacctcagtttggtagtccatgaaattgcgcaaatgatgatcaaataccaggccgtggtcgtgttggaaaatttaaataccggcttcaaacgtgtccggggtggtatttcagaaaaagcagtgtatcaacagttcgaaaaaatgttgatcgagaagttgaactttttagtgtttaaggatcgtgcgattaatcaagaaggtggcgtgctgaaggcgtatcaattaacagatagctttaccagcttcgctaaattagggaatcagagtgggtttctcttttacattccttccgcttacacttcaaaaattgatcctggtactgggtttgtggatccgttcatctggtctcatgttactgcatcagaagagaatcggaatgagtttttaaagggctttgattccctgaagtacgacgcgcagagttctgcgtttgtacttcatttcaaaatgaagagtaataaacaattccagaagaataacgtcgaaggcttcatgccagaatgggacatctgtttcgaaaaaaatgaagagaagattagcctgcaagggtcaaaatacaccgctggcaaacgtatcatttttgattcgaaaaagaaacagtacatggaatgtttccctcagaacgaattgatgaaggccctgcaagacgttggcattacctggaatacaggcaatgatatttggcaggatgtgttgaaacaggccagcacagacacgggcttccgccaccggatgattaatttgatccggtcagtgttgcaaatgcgttcgtcaaacggtgcaaccggggaagattacatcaattcaccagtaatggacctggatggccgtttcttcgacactcgcgccggcattcgcgatttgccacttgacgctgatgctaacggggcataccacatcgctttgaaaggccggatggttctggagcggatccgtagccagaagaacactgcaatcaagaataccgactggctctatgccatccaagaggagcgcaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1022 - DNA, 4098 bp, synthetic construct
  misc_feature 1..4098: note = Description of Artificial Sequence: Synthetic polynucleotide
  source 1..4098: mol_type = other DNA
atgggccaccatcatcatcatcatagcagcggcctggtgccgcgcggcagcggtaccatggctgcgttcgataagttcatccatcagtatcaagtgagcaagaccctccgcttcgccctgatccctcaggggaagactttggagaatacgaaaaacaacgtcttgcaggaagacgatgagcgccagaagaattacgaaaaagtgaagccgatcttagatcgcatctataaagtctttgctgaggagtctctcaaagattgcagtgtcgactggaatgacctcaacgcctgcctggatgcatatcaaaaaaatccttcagccgacaagcgccagaaggttaaagcggcccaagacgcgttgcgggatgagatcgctggctactttacgggtaagcaatatgctaacgggaagaataagaatgcagtaaaggaaaaggagcaagcggagttatacaaagatattttctcgaaaaaaatctttgatggcaccgtgacgaataataagctcccgcaagttaatctttctgcggaagaaacagaattgctcgggtgtttcgacaagtttacaacgtattttgtcggtttctaccaaaatcgcgagaatgttttttcgggcgaagatattgccacagctattccacatcgcattgtgcaggataacttccctaagtttcgggaaaactgtcggatctatcaggatttaattaagaatgagcctgccctcaagcctctgctccagcaagcagccgcagcagtcatggcacaaaatcctaaaggcatctaccagccgcgtaagtctctggatgatatttttgtcattcctttctacaatcatctcctcttgcaggatgatattgactattttaatcagattctgggcgggatctcgggtgcagcaggccagaagaagattcaggggctgaacgagaccattaatttgttcatgcaacagcacccgcaagaagcagacaaacttaaaaaaaaaaaaatccgtcatcggttcatcccattatataaacagatcttatctgatcggacatcattcagtttcattcctgaagctttctctaatagtcaggaagcactcgatggcatcgagactttcaagaagtcgcttaagaagaatgacacatttggcgcgctggagcgcctcattcaaaatcttgcttcattggatctgaagtacgtatacttgtccaataaaaaagtcaatgaaatttcgcaagcactttacggcgaatggcattgtatccaagacgtattaaagcaagatttctcgcttgagtcattgatccaaattaaccctcaaaattcttcgaacggttttttggctacgttgactgacgaggggaaaaaacgtatctcccagtgtcgtaacgtgttaggtaacccactgccggtcaaactggccgacgatcaagataaagcgcaagtcaagaatcaacttgatacccttctcgcggcagttcactatttggagtggtttaaagcagaccctgatctcgaaactgatccgaatttcacggttccattcgaaaagatctgggaggaactcgttccacttctgagcctctatagtaaagttcgtaattttgtaacaaagaagccgtattccaccgcaaaattcaaactcaacttcgccaatccaactctcgcggatggttgggacattcataaggagtcagataacggggcgctgttgtttgagaaaggtggtctctactatctggggattatgaatccgaaagacaagcctaattttaaatcgtatcaaggcgctgagccttactaccagaagatggtctatcgtttttttccggattgtagcaaaactatcccgaagtgttccacgcaacgcaaggacgtcaaaaagtattttgaggatcatccacaggctactagttaccaaatccacgactctaagaaggaaaaattccgccaggattttttcgagattcctcgggagatctacgagctcaacaatacgacgtatgggactggcaagtccaagtataagaagttccaaacacagtattaccagaaaacgcaggataaaagcgggtaccaaaaggcgcttcggaagtggatcgatttctcgaagaagttcttacagacatacgtgtcgaccagcatcttcgactttaagggcttgcgcccatcaaaggattatcaggacctgggggagttttataaagatgtcaatagtcggtgttaccgtgtgacattcgagaaaatccgcgtgcaggatattcatgaagcagttaaaaacggtcagctttacctgtttcaactttacaataaagacttttcaccgaagtcacatggccttccaaacctgcatacattgtactggaaggccgtatttgaccctgaaaatctcaaggatccaattgtaaagttaaacggtcaggccgaactcttttatcgtccgaaatcaaatatgcaaatcatccaacacaaaactggggaggaaatcgtcaacaaaaaattaaaggacgggactccagtccctgatgatatttatcgtgagatctctgcgtatgttcagggcaagtgtcaaggtaacctgtctccggaggccgagaagtggctcccgagtgtgactatcaaaaaggcagcccacgatattacaaaagaccgtcgtttcaccgaagacaaattctttttccacgtacctattacattaaattaccagagttcgggcaaaccaacagcctttaattcgcaggtaaatgattttttgactgaacaccctgaaactaacatcatcggcattgaccgcggtgaacggaatctcatctatgccgtggtgattactccagatggtaagatcttagaacaaaaatcgtttaacgtaattcacgattttgattatcacgaaagcctcagccaacgtgaaaagcaacgggtcgcggcccgccaagcctggaccgcgatcgggcgtattaaagacctgaaggaggggtatttgtcccttgtcgttcatgagattgcccagatgatgatcaaataccaggccgtcgtcgttctggagaatttaaacacaggctttaaacgtgtacggggggggatttcagaaaaggctgtttaccaacaattcgagaaaatgctcatcgagaagcttaatttccttgtttttaaagaccgtgcgattaatcaagagggcggggtacttaaggcgtaccaattgacggattcgttcacttcctttgccaagttagggaaccaatcggggtttttattctacattccgtctgcatacacctccaaaattgaccctggtacagggttcgtggacccgttcatctggtcgcacgtcacagcgtctgaagagaaccggaatgaatttttaaaagggttcgattctcttaagtatgacgctcaatccagcgcttttgtgcttcactttaagatgaaaagcaacaagcagtttcaaaaaaataacgttgagggcttcatgccggagtgggacatttgctttgagaagaatgaggagaaaatctcattacagggcagtaagtacacagcaggcaagcggatcatttttgactcaaagaaaaagcagtacatggaatgctttcctcagaacgaacttatgaaagccctgcaggatgtcgggatcacgtggaatacaggcaacgatatctggcaggatgtcttgaagcaagcgtcaaccgacaccggctttcgccatcgtatgatcaacttgattcgcagtgtgttacagatgcggtcctccaacggcgcgacaggtgaggattatatcaacagcccggtgatggacctcgatgggcggttctttgacacgcgtgccggcattcgtgacttgcctttggatgccgacgcgaacggtgcatatcatatcgcgctgaaaggccgcatggttctcgaacgcatccgcagtcagaagaacactgcaatcaagaatacggactggctttacgcaatccaagaggaacgtaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1023 - DNA, 4098 bp, synthetic construct
  misc_feature 1..4098: note = Description of Artificial Sequence: Synthetic polynucleotide
  source 1..4098: mol_type = other DNA
atgggccaccatcatcatcatcatagcagcggcctggtgccgcgcggcagcggtaccatggcggccttcgataaattcatccaccaataccaggtatcaaagactctgcggtttgccttgattcctcaaggtaaaactctcgagaatactaaaaacaatgtattacaagaagacgacgagcgtcaaaagaactacgaaaaggtcaaaccgattttggatcgcatctataaagtattcgcagaagagagtttgaaggattgtagcgttgactggaacgatttaaacgcatgcctggatgcttaccagaagaatcctagcgctgataaacgccagaaagtgaaagcagctcaggatgcgttacgtgacgaaattgcgggctatttcacgggcaaacagtacgctaacgggaaaaataagaatgccgtcaaagaaaaggaacaagcggagctctataaggacatctttagcaagaaaatttttgacggcactgtaactaacaataaattacctcaagtgaacctcagcgcggaggagactgaactcctggggtgtttcgataaatttactacatatttcgtgggcttttatcaaaatcgtgagaacgtcttctcaggggaagatattgccacggcgatccctcatcggatcgttcaagacaatttccctaaattccgggaaaattgtcgcatttatcaagatctcattaaaaatgagccggctttaaaacctttgctccagcaagctgccgcagcagtaatggcgcagaacccgaaaggcatttaccagccgcgtaaatctttagatgacatctttgttatccctttctacaatcaccttctcttacaggatgacattgattattttaatcagatcttggggggtatttcaggggcagcgggccagaagaagatccagggcctgaatgaaactatcaatctgttcatgcaacagcatcctcaggaagccgacaagcttaaaaagaaaaagatccgtcaccggttcattccgttgtacaagcagattctgtcagaccgcacgagtttttcctttatcccagaggcgttcagcaactcgcaagaagccctcgatggtattgaaacttttaaaaagagtctcaagaagaatgatacttttggtgcactcgagcgtttaattcaaaacctcgcgtcgttggatctcaagtacgtgtacttatctaacaagaaagtaaacgaaatttcacaagcgctctatggtgagtggcattgtattcaagatgtgttaaagcaagatttctcgcttgaatcccttattcagatcaacccacagaactccagtaatggcttcctcgccactctcacggacgaaggcaaaaagcgcatttcgcagtgccggaatgtactggggaatccgttgccagtgaaattagctgatgatcaagataaagcacaggtcaaaaaccaattggacactctcctcgctgcggttcactatctcgaatggttcaaagcagatccggatctcgaaaccgacccgaactttacagttcctttcgagaagatttgggaggagctcgttccattactttccctttacagtaaagtacgcaacttcgtaacgaaaaaaccttatagtactgccaagttcaagttaaacttcgcgaatcctacgttagctgacgggtgggacattcataaagagtctgataacggggctcttttgttcgaaaaaggtggtttgtattacttaggcattatgaacccgaaggataagccgaacttcaagagctaccagggcgccgagccttattatcaaaagatggtttaccgcttcttcccggactgttcaaaaacgattcctaaatgttctacccaacgtaaggacgtcaaaaagtactttgaagatcatccacaggcgacttcgtaccagatccatgattcaaaaaaagagaagtttcgccaggatttttttgaaattccacgggagatctatgagcttaacaacacgacgtatggcaccgggaagagtaaatacaagaagttccaaacacaatactatcaaaagacacaagataaaagcgggtaccagaaggcgttgcgtaaatggatcgactttagtaagaaattcctccagacgtacgtttccacgagcatttttgatttcaaaggcttgcgcccgagcaaagattatcaagacttgggcgagttctacaaggatgttaacagtcgttgctaccgggtcacttttgaaaaaatccgggttcaagatatccatgaggccgttaagaatgggcagttgtatttattccagttatataataaagacttctctcctaagtcgcatggtctgccaaacctgcataccttgtattggaaagcggtatttgatccggagaatttaaaggatcctattgtaaaattaaacgggcaggcagagcttttctaccggccgaagtccaacatgcaaattattcagcataagaccggggaagaaatcgtaaataaaaaactcaaagacgggactccagttccggacgacatttaccgggaaatcagtgcctatgtgcaaggcaaatgtcagggcaatcttagtccagaagcggagaaatggctgccgtcagtaaccatcaagaaggcagcgcacgatattactaaggatcgccgttttactgaagataaatttttctttcatgtaccaatcacactcaattatcagagtagtggtaaaccaaccgcgttcaacagtcaagtaaatgacttcctcactgagcaccctgagaccaacattatcggtatcgatcgtggcgaacgcaatttaatttacgctgttgtcatcacaccagatgggaagattttggaacagaaaagttttaacgttattcatgactttgattaccatgagagcttatcgcaacgggagaaacaacgcgtggctgcgcggcaggcttggacggcaattggtcgcatcaaggatttgaaggaagggtacttaagcctcgtggtgcatgagatcgctcaaatgatgattaaatatcaggcagtcgttgttctggagaaccttaacactggtttcaaacgtgtacgtggtggcattagcgaaaaagctgtctaccagcaattcgaaaagatgttaatcgaaaagttgaactttctcgtctttaaggatcgtgctattaaccaggagggcggcgtgctcaaagcttaccaactcactgattcgttcactagtttcgcgaagctgggtaatcaatcgggtttcctcttctacattccttctgcatataccagcaaaattgacccaggcacgggttttgtagacccatttatttggtcacacgtcactgcttcggaggaaaaccggaatgaattcttaaagggctttgattccttaaaatatgatgcccaaagtagcgcgtttgtattgcattttaaaatgaaatcaaataaacaatttcagaaaaacaatgtagagggcttcatgccggaatgggacatctgctttgaaaagaatgaagagaagatctctctgcagggtagcaagtatacggcagggaaacgtatcatttttgactccaaaaagaagcaatacatggaatgctttccgcaaaatgagttaatgaaggcattgcaagacgtggggattacatggaacactgggaatgacatctggcaggacgttctcaaacaggcttctactgataccggttttcgccaccgtatgatcaatctgattcggtctgtgctccaaatgcgctcatccaatggtgccacaggcgaagattatatcaactctccagttatggacctcgatggtcggttttttgatacgcgtgcaggcattcgcgatttgcctctcgacgctgatgcaaacggtgcgtaccatattgcgttaaaggggcgtatggtgctggaacggattcgttcgcagaaaaacacggctatcaagaacacggactggctctatgctattcaagaggaacgcaacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1024 - DNA, 4098 bp, synthetic construct
  misc_feature 1..4098: note = Description of Artificial Sequence: Synthetic polynucleotide
  source 1..4098: mol_type = other DNA
atgggccaccatcatcatcatcatagcagcggcctggtgccgcgcggcagcggtaccatggcagccttcgacaaatttattcaccagtatcaagtctccaaaactctgcgttttgcgttgattccgcagggtaaaactttggaaaacacaaaaaataacgtattacaggaggatgacgagcgccagaagaattatgaaaaagtgaaaccaattctggaccgtatctacaaagtattcgctgaagagtcgttaaaggactgctcagttgattggaatgacctgaatgcttgtctggatgcttatcagaagaatcctagcgcggacaaacgccagaaggtcaaggctgcgcaggatgcactccgcgatgagattgcggggtacttcacgggcaagcagtacgcaaatggcaaaaataagaacgccgtgaaggaaaaagaacaggctgaattgtacaaggatatcttctcgaaaaagatcttcgacggcactgtgaccaataataaattgcctcaagtgaatctgtcggctgaagaaaccgaattactcggttgctttgataagtttactacctacttcgtgggcttttatcaaaaccgcgagaacgtgttctctggtgaggatattgcgacagcgatcccacaccgcatcgtccaggacaacttcccgaagtttcgggaaaactgccgcatttatcaggatttgattaaaaatgaacctgcactgaaacctctcctgcaacaggccgctgcggccgtgatggcgcagaaccctaaaggtatttaccaaccgcgcaaatctctcgatgacatcttcgtcatccctttctataatcacctgctgcttcaagatgacatcgattattttaatcagatcctcggtggtatctcgggggctgccggtcagaagaagattcaggggttgaatgaaacaatcaacttgtttatgcagcagcatccgcaggaagcagataaacttaaaaaaaaaaaaattcgtcatcgtttcattcctctttataagcaaatcctttccgatcgtacaagttttagcttcatcccagaggcgttctctaactcgcaggaagcactggatgggatcgagacttttaaaaaatcgttgaagaaaaatgatacattcggggcgctcgaacgcttgatccaaaacttggcttctctggaccttaagtatgtatacctttccaataaaaaagtaaacgagatctcccaggctttatacggcgaatggcattgcatccaagatgtccttaaacaagactttagtttagaatcattaatccagatcaacccgcaaaattcttccaatggctttttagccacactcacggacgaaggcaaaaagcgtattagccaatgtcggaatgtgctgggtaatccactccctgttaagctggcagatgatcaggataaggctcaagtgaagaaccagctcgacacattacttgcagctgtccattatttagaatggtttaaagctgatccagatttggaaacagacccgaacttcacggttccatttgaaaaaatctgggaagagctcgtgcctctgttatcgctttattctaaagtccgcaatttcgtcacgaagaaaccttacagcacagcaaaatttaaactgaacttcgccaatcctacactcgcggatgggtgggacattcacaaagaaagtgataatggcgccttactgtttgaaaaaggtggtctttattaccttggcattatgaacccgaaggacaaaccaaacttcaagtcatatcaaggcgctgaaccgtattatcagaagatggtctatcggttctttccggattgtagcaagactatcccaaagtgctccacgcaacggaaggacgttaaaaaatactttgaggaccacccacaagctacgtcatatcaaatccatgacagtaaaaaggagaagttccgtcaggattttttcgagattccacgcgaaatttatgagctgaataatacaacttacggcacaggtaagagtaaatacaaaaagtttcagacacaatattatcaaaagacgcaggataagtccggttatcagaaggctctgcggaagtggatcgatttctcaaagaagttccttcaaacttacgtgtcgacctctattttcgattttaaaggcttgcgcccgtcgaaagactatcaagatcttggcgagttttataaggacgttaacagccgctgctaccgggtaacttttgagaagattcgcgtccaagacatccatgaggcagtcaaaaatggccagttatacttatttcaactctacaacaaggactttagccctaagtctcatggtttgcctaacttacataccttatattggaaagctgttttcgatccagagaatttgaaggatccgattgtgaagctcaatggccaagctgagttattttatcgcccgaagtccaacatgcaaattattcagcacaaaaccggcgaagagattgtcaacaagaaattgaaggacggtactcctgtgcctgatgacatctaccgcgaaattagcgcgtatgtgcagggcaaatgccaggggaacttatctccggaggcggagaaatggctcccatcagtgaccattaagaaagctgcgcacgacattactaaagatcgccgttttactgaggataaatttttctttcatgttcctatcactctcaattaccaatctagcggcaaacctacggcgtttaattctcaggttaacgatttcttaacagaacacccagaaacaaacattatcgggattgaccgcggtgaacgtaatcttatctatgcggtggtcattactccggatggtaaaatcctcgaacagaaatcatttaatgttattcacgatttcgattatcatgagtcacttagtcaacgggagaaacagcgtgtcgctgcccggcaggcttggacagcgattggccgtatcaaggacctgaaggagggctatttatcattggttgtgcatgaaattgcccaaatgatgatcaagtatcaggcggtcgtggtactggagaatctgaacaccggctttaagcgggtacgcggtgggatttcagagaaggcagtataccaacagtttgaaaaaatgctgattgagaaattgaattttctggtcttcaaagatcgcgcgatcaaccaagaggggggtgtactcaaagcatatcagttgacggattcgttcacctcctttgctaagcttgggaaccaatcggggtttctgttttacattccatctgcctacacgtcgaagatcgatccggggacaggctttgtagatccatttatttggtcacatgtgactgctagcgaagaaaatcgtaatgaattcctcaaggggttcgattcgctcaagtacgatgcacagtcatctgcatttgtccttcattttaagatgaaaagtaacaaacagtttcagaagaataatgtcgaaggttttatgccagaatgggatatctgcttcgagaagaacgaggaaaagattagtctgcaaggttcgaaatataccgccgggaaacgtatcattttcgattctaaaaaaaaacagtacatggagtgctttccgcaaaacgaactcatgaaggccctccaagacgtaggcatcacgtggaacacaggcaatgatatctggcaggatgtcctgaaacaggcatcaaccgataccggcttccgccatcgcatgatcaacttaatccgttccgtattacagatgcgctcgtccaatggggcaacaggtgaggattacattaatagccctgtcatggatctcgacggccgtttctttgatacacgcgccgggatccgggatttaccgctcgacgcagacgcgaacggggcatatcatatcgctttaaaggggcgcatggtccttgaacggattcgttcgcaaaagaatacggcaattaaaaatactgactggttgtatgcaatccaagaggaacgcaacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1025 - DNA, 4098 bp, synthetic construct
  misc_feature 1..4098: note = Description of Artificial Sequence: Synthetic polynucleotide
  source 1..4098: mol_type = other DNA
atgggccaccatcatcatcatcatagcagcggcctggtgccgcgcggcagcggtaccatggctgcctttgacaaattcattcatcaatatcaggtttctaaaacattgcgttttgcacttattccgcagggcaagacgctcgagaatactaaaaataatgtgctccaggaagatgacgagcgtcagaagaactatgagaaggtcaaaccaattctggaccggatttacaaagtattcgcggaggaatcactgaaggactgcagtgttgactggaatgacctcaatgcttgcttagacgcgtatcaaaagaacccgagcgcagataaacggcagaaagtaaaggctgcgcaggacgctctgcgggacgaaatcgccggctactttacgggcaaacaatatgccaacggcaagaataagaacgccgtcaaagagaaagagcaggctgagttgtacaaggacatcttttccaagaaaatttttgacggtaccgtaacgaacaataaactgcctcaggttaacttgtccgcggaagagaccgaacttctcggctgttttgataagtttaccacatatttcgtcggtttttaccaaaatcgcgagaacgtcttcagcggcgaagatattgcgacggcaatccctcaccgcatcgttcaggacaacttccctaaatttcgtgaaaactgccgcatctatcaagacttgatcaaaaacgaacctgcgttgaagccgctcttgcaacaagcagccgccgcagtcatggcgcagaatccgaagggtatctaccaaccgcgtaaatcactggacgatattttcgtgattccattctacaatcaccttctcttacaggacgacatcgactacttcaatcaaatcttgggtgggatctctggtgctgcaggtcaaaaaaaaattcaaggtttaaatgagaccatcaaccttttcatgcaacaacatccacaggaggcagataagctgaagaaaaagaagattcgtcaccgctttatcccgctctacaaacagattttaagcgatcggacgagtttctcgttcatcccggaggcgttttcgaactcccaggaagcgcttgacggtatcgaaacgtttaagaaatcattgaaaaaaaatgacacgtttggggctctggagcgccttatccagaatctggcgtccttggatttgaaatatgtgtacctcagtaacaagaaggtcaacgaaatttcacaggctctttacggtgagtggcactgcatccaagacgttctgaaacaggatttttcactggaatcactgatccaaattaacccgcagaatagttcaaatggtttcttggcgacccttaccgatgaagggaagaaacggatttcacagtgccgtaacgtgctggggaaccctttgcctgttaaattggcagatgatcaagataaggcacaggttaaaaatcaacttgacacattattggcggctgtacactacttagagtggtttaaggctgaccctgatttagagacagacccaaatttcacggtgccatttgaaaagatctgggaagagctcgtgccgctcttaagtttatactccaaggtgcgcaacttcgtcacgaagaagccgtattcgacggcgaagttcaagttaaacttcgctaatccgaccctggcggatgggtgggatattcataaagagtcagataatggcgcattgctcttcgagaaaggcggtttgtattatctggggatcatgaaccctaaagacaaacctaattttaagtcgtaccaaggggcggaaccgtattaccagaagatggtttatcgtttctttccagactgcagtaaaacgattccaaagtgctctactcagcgtaaagacgtaaagaaatactttgaggaccacccgcaggcgaccagttatcaaattcacgacagtaagaaagaaaagtttcgccaggattttttcgagattccgcgtgagatttatgaattgaacaataccacgtatggcaccggcaaatcgaaatataagaaattccaaactcaatactaccagaagacccaagataagtcaggctaccaaaaagccctccgtaaatggattgatttttctaaaaagtttttgcaaacctatgttagcacatcaatctttgactttaaggggttacgcccaagcaaggactatcaggacctcggggaattctataaggacgttaattcgcggtgttaccgggttactttcgagaagattcgggtgcaagatattcacgaggcagtcaaaaatgggcagctgtatctgtttcaactctataataaagatttcagcccgaaaagccatggtcttccgaatcttcacactttatactggaaagcagtattcgacccggaaaacttaaaggatccgattgtgaagttgaacggtcaagcggaacttttctatcgcccaaaaagtaatatgcaaatcatccagcataagaccggtgaggagatcgtcaacaagaagttgaaagatgggactccggtgcctgacgacatttaccgtgagatttccgcatatgttcaaggtaagtgccaaggtaatttaagccctgaagcagaaaaatggctcccgtcggtcactattaagaaagctgcccatgatatcactaaagaccgtcgctttactgaagacaaattttttttccatgtgcctattacgctgaattaccaatcgtctgggaagccgacggcattcaactctcaggttaacgactttcttactgaacacccagaaactaacatcatcggtattgatcgtggcgaacggaacctcatttatgccgtggtaattacgcctgacgggaagattctcgaacaaaagtctttcaacgttatccacgactttgactaccacgaatcgttgagtcaacgtgaaaaacaacgtgttgcggcgcgccaggcatggacagctatcgggcgtatcaaggatctgaaagagggttacctgtcgctggtcgtgcacgagattgcgcaaatgatgattaaatatcaagcagtggtagtgcttgagaatcttaacactggtttcaaacgtgtgcgcggggggatttcggaaaaggctgtttaccagcaatttgaaaagatgctcattgaaaagttgaattttctcgtctttaaagaccgtgccatcaatcaagaaggtggcgtgcttaaagcataccagttaaccgactcattcacgtcatttgcaaaacttgggaaccagagtggcttccttttctacatcccttcagcgtacacatcaaagattgacccagggactggctttgttgatccatttatctggagtcacgtcaccgcgagtgaagagaaccgcaatgaatttctcaagggctttgattcattaaaatacgatgctcagagctcagcatttgtgttgcacttcaagatgaaatcgaataagcagttccagaaaaataatgtcgaaggcttcatgcctgaatgggatatctgtttcgagaaaaatgaagagaagatcagcttacagggttctaaatacacggcaggtaagcggattatcttcgattctaagaagaaacagtacatggaatgtttccctcaaaacgagctgatgaaggccttacaagatgtggggatcacctggaacaccggtaacgatatttggcaagacgtattaaaacaagcgtcgacagataccggttttcgtcaccgtatgattaacctgatccggagtgtgttgcaaatgcgcagcagcaatggcgcaacgggcgaagattacattaacagtccagtcatggacctggacggccggttcttcgacacgcgggcagggattcgggatctccctctggatgctgatgctaacggcgcctaccatattgcgctgaaggggcgtatggttttggagcgtattcgttctcagaagaacactgccatcaaaaatacggactggttatacgcgatccaggaggagcgcaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1026 - protein, 1310 aa, synthetic construct
  REGION 1..1310: note = Description of Artificial Sequence: Synthetic Cas12a/Cpf1 [Sedimentisphaera cyanobacteriorum] sequence
MKEFTNQYSLTKTLRFELRPVGETAEKIEDFKSGGLKQTVEKDRERTEAYKQLKEVIDSYHRDFIEQAFARQQTLSEEDFKQTYQLYKEAQKEKDGETLTKQYEHLRKKIAAMFSKATKEWAVMGENNELIGKNKESKLYQWLEKNYRAGRIEKEEFDHNAGLIEYFEKFSTYFVGFDKNRANMYSKEAKATAISFRTINENMVKHFDNCQRLEKIKSKYPDLAEELKDFEEFFKPSYFINCMNQSGIDYYNISAIGGKDEKDQKANMKINLFTQKNHLKGSDKPPFFAKLYKQILSDREKSVVIDEFEKDSELTEALKNVFSKDGLINEEFFTKLKSALENFMLPEYQGQLYIRNAFLTKISANIWGSGSWGIIKDAVTQAAENNFTRKSDKEKYAKKDFYSIAELQQAIDEYIPTLENGVQNASLIEYFRKMNYKPRGSEEDAGLIEEINNNLRQAGIVLNQAELGSGKQREENIEKIKNLLDSVLNLERFLKPLYLEKEKMRPKAANLNKDFCESFDPLYEKLKTFFKLYNKVRNYATKKPYSKDKFKINFDTATLLYGWSLDKETANLSVIFRKREKFYLGIINRYNSQIFNYKIAGSESEKGLERKRSLQQKVLAEEGEDYFEKMVYHLLLGASKTIPKCSTQLKEVKAHFQKSSEDYIIQSKSFAKSLTLTKEIFDLNNLRYNTETGEISSELSDTYPKKFQKGYLTQTGDVSGYKTALHKWIDFCKEFLRCYRNTEIFTFHFKDTKEYESLDEFLKEVDSSGYEISFDKIKASYINEKVNAGELYLFEIYNKDFSEYSKGKPNLHTIYWKSLFETQNLLDKTAKLNGKAEIFFRPRSIKHNDKIIHRAGETLKNKNPLNEKPSSRFDYDITKDRRFTKDKFFLHCPITLNFKQDKPVRFNEQVNLYLKDNPDVNIIGIDRGERHLLYYTLINQNGEILQQGSLNRIGEEESRPTDYHRLLDEREKQRQQARETWKAVEGIKDLKAGYLSRVVHKLAGLMVQNNAIVVLEDLNKGFKRGRFAVEKQVYQNFEKALIQKLNYLVFKEVNSKDAPGHYLKAYQLTAPFISFEKLGTQSGFLFYVRAWNTSKIDPATGFTDQIKPKYKNQKQAKDFMSSFDSVRYNRKENYFEFEADFEKLAQKPKGRTRWTICSYGQERYSYSPKERKFVKHNVTQNLAELFNSEGISFDSGQCFKDEILKVEDASFFKSIIFNLRLLLKLRHTCKNAEIERDFIISPVKGNNSSFFDSRIAEQENITSIPQNADANGAYNIALKGLMNLHNISKDGKAKLIKDEDWIEFVQKRKF

SEQ ID NO: 1027 - DNA, 3933 bp, synthetic construct
  misc_feature 1..3933: note = Description of Artificial Sequence: Synthetic Cas12a/Cpf1 [Sedimentisphaera cyanobacteriorum sequence
  source 1..3933: mol_type = other DNA
atgaaggaattcaccaatcagtattctcttaccaaaacgctccgatttgagcttcgtcctgttggagagacagcagaaaaaattgaagatttcaaaagtggagggctcaagcagactgttgaaaaagaccgcgaaaggacagaggcttacaagcagctcaaagaagttattgattcataccacagggatttcatagaacaggcctttgcaaggcagcaaactttaagcgaagaagatttcaagcaaacttatcagctctataaagaagcccagaaagagaaagacggcgaaacattaactaaacaatacgagcatctcagaaaaaaaattgcagccatgttcagcaaagccactaaggaatgggctgtaatgggggaaaataacgaattaataggcaagaacaaagaatcaaagctctatcaatggctcgaaaaaaattacagggcaggcaggattgagaaggaagagtttgatcataatgcagggcttatcgaatatttcgaaaaattttctacatattttgttggctttgataaaaacagggcaaatatgtattccaaagaggctaaggctacagccatatcttttcgcaccataaacgaaaatatggttaagcatttcgataactgccagagattggaaaaaataaaaagcaaataccctgatcttgctgaagagctaaaggattttgaagaattcttcaagccttcatatttcattaattgcatgaaccagtccggaattgattattacaatatcagcgcaattggcgggaaagacgagaaggatcagaaggccaatatgaaaatcaaccttttcacccagaaaaaccatctcaagggctctgataagcccccgtttttcgccaagctctacaagcagattctcagcgacagagaaaagagcgtagttatagatgaattcgaaaaagacagcgaacttaccgaagctctcaaaaatgttttcagcaaagatggcttaatcaatgaagaatttttcactaaactaaaatcagctctcgaaaactttatgctccccgaatatcagggacagctctacatcaggaacgcctttctaacaaaaatctcagcgaacatttggggttcaggcagctggggtataatcaaagatgccgttactcaagcggcagaaaacaactttaccagaaaaagcgacaaagagaaatatgccaaaaaggatttttacagcatcgccgagcttcagcaggcaatcgatgaatatatcccaaccctcgaaaacggagttcaaaacgcctctctaattgaatatttccgcaaaatgaattacaagcccagaggcagcgaagaagatgcaggcctaatagaagaaataaacaataatctacgtcaggcaggaatagttcttaaccaggcagaactgggcagcggaaagcagcgagaggaaaatatcgaaaagatcaaaaatctgctcgattcggttttaaatctggagcgttttttgaagcccctctaccttgaaaaggagaaaatgaggccgaaggcagcgaatttgaacaaagatttctgcgaaagctttgaccctttatacgaaaaactgaaaacatttttcaaactctacaataaggtgagaaattacgccaccaaaaagccatacagcaaagacaaattcaaaatcaatttcgacacagctaccctgctttacggctggtcactggataaggaaacggctaatctttctgttattttcagaaagcgggaaaaattctatctcggaattataaacaggtataactctcagattttcaactataaaatagcaggcagtgaaagcgaaaagggcttggaaagaaagcggagccttcagcaaaaggtattggcagaagaaggcgaagattattttgaaaaaatggtttatcatttattgctgggcgcttcaaagacaatcccgaaatgctccacccagcttaaagaagttaaagctcatttccaaaaaagcagcgaagactatattatccaaagcaaaagttttgcaaagtcgcttactttaacaaaagaaatctttgatttgaacaatctaagatacaacacagaaacaggcgaaatatcatcagaactttctgatacttacccgaaaaagtttcagaaagggtatctcacccagactggtgatgtttccgggtataaaaccgctctgcataagtggattgatttttgcaaagaatttctcagatgctaccgcaataccgaaatctttactttccatttcaaggacaccaaggaatatgaatctcttgatgagttcctcaaagaagttgattccagcggttacgaaatcagtttcgataagataaaggcttcatacataaatgaaaaggttaacgcaggcgagctttatcttttcgaaatatacaacaaggatttctctgaatacagcaaaggaaagcccaacctgcacaccatttattggaaaagcctttttgagacgcagaatcttctcgataaaacagctaagctcaacgggaaggcagagatattcttccgcccccggtctatcaaacacaacgataaaataatacacagggcaggcgaaacgcttaaaaacaaaaatccattaaatgaaaagccctcaagcagatttgattacgacattacaaaagacagaagatttactaaagacaaatttttccttcactgcccgataacactgaatttcaaacaggacaagcctgtccgtttcaatgagcaggtaaatctatatcttaaggacaaccccgatgtaaacatcatcggaatagacaggggcgagagacatcttctctactacacgctaataaatcagaacggcgaaatcctccagcagggctcgcttaatagaatcggggaagaagaaagccgcccgacagattatcatcgtctccttgatgagcgggaaaagcagcggcagcaggccagagaaacatggaaagctgtggagggcatcaaagacctcaaagccggctatctttcccgcgtggttcataagcttgcagggctgatggtgcagaataatgcaatagttgtgctggaagatttaaacaaaggcttcaaacgagggcggtttgctgtggaaaagcaggtgtatcagaatttcgaaaaagcccttatccaaaagctgaactaccttgtattcaaagaggtcaattcaaaagacgcccccggccattaccttaaagcttatcagcttacagcaccttttataagctttgaaaagcttggtactcagagcggttttcttttctacgtgcgggcctggaatacatcaaaaatagaccctgcaacaggttttacagaccagattaagcctaaatacaaaaatcaaaagcaggcgaaagattttatgagcagttttgattctgtaaggtacaaccgtaaggaaaactatttcgagtttgaagcagactttgagaaattagcccaaaagcccaaaggacgaacccgctggacaatctgctcctacgggcaggaaagatactcttacagccccaaagaaaggaaatttgtaaaacacaacgttactcagaatcttgcagagcttttcaattcagaaggcatctcttttgattcaggccaatgcttcaaagatgaaatcttgaaagttgaagacgcttcatttttcaaatctataattttcaatctgcgtttgcttttgaagctgcgccacacctgcaaaaatgcagaaatcgagagagattttataatctcgccggtgaaagggaataattcaagtttcttcgattcgcgaatagccgagcaggaaaacataacatctatcccgcaaaacgcagatgcaaacggggcttacaatattgccctcaaaggccttatgaatcttcataatatcagcaaagacggaaaagcaaaacttataaaagatgaggactggatcgaattcgttcagaagaggaaattttag

SEQ ID NO: 1028 - DNA, 4122 bp, synthetic construct
  misc_feature 1..4122: note = Description of Artificial Sequence: Synthetic polynucleotide
  source 1..4122: mol_type = other DNA
atgggccaccatcatcatcatcatagcagcggcctggtgccgcgcggcagcggtaccatgaaagagttcacgaatcagtattcgttaactaaaaccctccgttttgaactccgtccggtgggcgagacggcggaaaaaattgaggactttaagtctgggggtttaaagcaaactgtggagaaagaccgtgaacgtaccgaggcgtacaagcagcttaaggaggtgatcgacagttatcatcgggattttattgagcaagcctttgctcgtcaacagactttgtcagaggaagattttaaacaaacgtaccaactgtacaaagaggcccaaaaagaaaaagacggggagaccttaacgaaacaatatgaacatctgcgcaaaaaaattgcagcaatgttttcaaaggccacgaaggagtgggccgtcatgggcgaaaacaacgagttgatcggtaagaacaaagaatcgaaattataccaatggcttgagaagaattaccgcgccggccgtatcgagaaagaagagtttgatcacaatgccggtcttatcgaatatttcgagaagttcagtacctacttcgtgggtttcgacaaaaaccgcgcaaatatgtactcgaaggaagccaaggccaccgcaattagtttccgtaccatcaatgagaatatggtaaagcatttcgacaattgtcagcgtcttgagaaaatcaagagtaagtacccagatttagctgaagaattaaaggattttgaagagttttttaaaccgtcgtacttcatcaattgtatgaaccaatccggcatcgattactacaatatttctgctattgggggtaaggacgagaaagaccagaaggcaaatatgaagatcaacttattcacgcaaaagaaccacttgaaaggctcagacaagcctcctttctttgcgaaattgtacaagcagatcttgagtgaccgggagaaaagtgtggtgattgatgaattcgagaaagattcagaattgacggaggcccttaaaaacgtgttctctaaagacgggctcatcaacgaagaattcttcacgaaactcaagtctgcacttgagaactttatgctcccagagtaccaagggcaattatacattcggaatgctttcctcacgaaaatctcagcaaatatctgggggagcgggagctggggcattatcaaagacgctgttacccaggcggcggagaacaactttactcggaagtcagacaaggaaaaatatgcgaagaaggatttctacagtatcgctgagttgcagcaggcaatcgacgaatacattccaacgctggagaatggtgttcagaacgcaagccttatcgagtactttcggaaaatgaattataagccgcgggggagtgaggaagatgctggcttaattgaagaaatcaacaacaatttacgccaagctggcatcgtattgaaccaggccgaactcggcagcgggaagcagcgtgaagaaaacatcgagaagatcaagaaccttctcgattcggtcctgaacctggagcgtttccttaagccgctttacctcgagaaagagaaaatgcgcccaaaggctgcgaacttgaacaaagacttttgcgaatcatttgatccattatatgagaaattgaaaacgtttttcaaactttataataaagtacgtaattacgctactaagaaaccgtactctaaagataagttcaagatcaacttcgatacagccacgttgctttatggctggtcgttagataaggaaacggccaacctttcggttatcttccgtaaacgcgagaaattctacctcggcattattaatcggtataacagccagatcttcaattataagatcgccgggagcgaatcggagaaggggttagaacgtaaacgcagcctccaacagaaagtattggccgaagaaggtgaggactacttcgaaaagatggtttaccatctcctccttggtgcaagcaaaacgatcccaaaatgcagtacacaacttaaagaggttaaagcccattttcaaaaatcttccgaagattacatcattcaaagcaaatcattcgctaagtcactgaccctcaccaaagagattttcgatttaaacaatcttcgctacaacactgaaacgggggaaatctcgtcagaactttctgatacttacccgaaaaaatttcagaaaggttatttgactcagactggcgacgtgtccggctataaaactgccttgcacaagtggattgacttctgtaaagaattcttacgttgctatcgcaacacagagatttttaccttccatttcaaggatactaaggaatatgaatcattggacgagtttcttaaagaggtcgattcctctgggtatgagatttcattcgacaaaatcaaagcgtcgtacatcaacgaaaaagtgaatgcgggggaattatatttattcgagatctacaataaggactttagcgagtatagcaaagggaagcctaatctccatacgatctactggaaatcactgttcgaaacacaaaatctcctcgacaaaacagcgaagctcaacggcaaggctgagatcttttttcgcccgcgttctatcaaacacaatgacaaaattatccaccgcgccggtgaaaccttaaaaaataagaatccattaaatgagaaacctagctctcgtttcgactatgatattacgaaggaccggcggttcacgaaggacaagttcttcttgcactgtcctattacattaaatttcaagcaagataagccagtccggttcaatgagcaagttaatctttatcttaaagacaaccctgacgtcaatatcattggtattgaccgtggtgaacggcacttattgtattataccttaatcaatcagaacggggaaattctgcaacagggctctttgaaccgtattggcgaagaggagtcacgccctaccgactaccaccgtctcttagatgaacgcgaaaaacagcgtcagcaggcacgggaaacttggaaagctgtagaaggtattaaagacctcaaggccggttatctttcacgcgttgtacataaacttgcaggcctgatggtgcaaaataacgctatcgtcgtcttggaggacctgaacaaaggttttaagcgggggcggtttgctgtagaaaaacaggtgtatcaaaacttcgagaaggcattgatccaaaagcttaactacctggtgtttaaagaggtaaactcaaaggatgctccaggtcattatcttaaagcataccaattaaccgccccttttatttcattcgagaagcttgggactcaaagtggtttccttttttatgtgcgcgcttggaacaccagtaagatcgaccctgcgaccggtttcacagaccagattaagccgaagtataaaaatcagaagcaagcaaaggattttatgagtagttttgattctgtgcgctataatcggaaagagaactactttgaatttgaggcagacttcgaaaaacttgcacaaaagccgaagggccgcactcggtggactatttgctcatatgggcaggagcggtatagctacagtccaaaggaacgcaaattcgtcaaacataatgttacgcaaaatcttgccgaactctttaactcagaaggcatttcttttgacagtggccagtgcttcaaagatgaaattttgaaggtggaggatgcctctttcttcaagagtattatttttaacttgcgtctcttattgaaattacgtcacacatgcaaaaacgcagaaattgagcgcgattttattatctctcctgttaagggcaataattcatcgtttttcgacagccgcattgctgaacaggagaacattacatcaattcctcagaatgccgacgccaacggcgcctacaatattgcgctcaaaggcttgatgaacctgcataacatctcgaaggacggcaaagcgaagttaatcaaggatgaggattggatcgaattcgttcaaaaacgtaaatttggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1029 - DNA, 4122 bp, synthetic construct
  misc_feature 1..4122: note = Description of Artificial Sequence: Synthetic polynucleotide
  source 1..4122: mol_type = other DNA
atgggccaccatcatcatcatcatagcagcggcctggtgccgcgcggcagcggtaccatgaaagagttcacgaaccagtactccttgacaaagactttacgctttgaattgcgtccagtcggtgagactgcagagaaaattgaagactttaagtctggggggttaaaacagactgttgaaaaggatcgggaacggaccgaagcatacaaacagctgaaagaggttatcgattcataccaccgggactttattgaacaggctttcgctcggcaacaaaccttgtcagaggaggacttcaaacaaacataccaattgtacaaagaagcacaaaaagaaaaggacggcgaaacactcaccaagcagtacgagcacttgcgtaagaaaatcgcagctatgttttcgaaagcgacaaaggagtgggctgtcatgggcgagaacaacgagcttatcggtaaaaataaagaatccaaactttatcaatggttggaaaagaactatcgcgcaggtcgcattgaaaaggaggagttcgaccacaacgcagggttgattgagtatttcgaaaagtttagtacctactttgtgggtttcgataagaatcgcgccaatatgtactcaaaagaagctaaggccacagccatctccttccgtaccatcaacgaaaatatggttaaacattttgataactgccaacgtctggaaaagattaagagcaaataccctgatttagctgaggagctcaaggactttgaagaattctttaagccttcatactttatcaactgcatgaaccaaagcgggatcgattactataatatctccgcgatcgggggtaaggacgaaaaagatcaaaaagccaacatgaaaatcaatctttttacgcagaagaaccaccttaaggggtcagacaaacctccattcttcgctaaactgtataaacaaatcttatccgatcgtgagaaatccgttgttattgacgaattcgagaaggatagcgagctgacagaagccttgaagaacgtatttagcaaagacgggctcatcaacgaggagttctttacgaaacttaaatcggcactggaaaactttatgcttcctgagtatcaaggccagttatatatccggaatgcatttctcactaagatctccgctaacatctggggttctgggtcatgggggatcattaaggacgctgttacacaggcagctgagaacaattttactcgtaaaagtgataaggaaaaatatgcgaaaaaagatttttatagtatcgccgagctccaacaggctattgacgagtacatcccgaccctggaaaacggtgtacaaaatgcatctctcatcgaatacttccgtaagatgaattacaaaccgcgtgggtctgaggaagacgctgggctcatcgaagaaattaataacaacctccgtcaggcgggcatcgtgcttaatcaagcggagctgggcagtgggaagcaacgggaggaaaacatcgaaaaaatcaagaatttgttggactctgtactgaacctggaacgcttcctcaagccattatacctcgaaaaggaaaaaatgcgcccaaaagcggcaaacctcaataaggatttctgcgagtccttcgatcctctttacgaaaagctcaaaaccttttttaaactgtacaataaagttcggaactatgcgacgaagaaaccatattcaaaggataagtttaagatcaactttgatactgcaacacttttatatggctggtcgctcgacaaggaaacggccaatctgtctgtaatttttcgtaaacgcgagaagttctatctcggtatcattaatcgttataactcacaaatcttcaattacaaaatcgcaggctcggaatcggaaaaggggcttgaacgcaaacgctccctgcaacagaaggttctcgctgaagaaggggaggactattttgagaagatggtctatcatttgctcttaggggcgtctaagacaattccgaaatgcagtacccaactgaaggaagtgaaggcgcatttccaaaaatcttcagaggattatattatccaatcaaaatcttttgcaaagtcactgacccttaccaaagagatttttgaccttaataatttacggtataacacagaaactggtgagatttccagtgaacttagtgacacttatcctaaaaagtttcagaagggttacctgactcagacaggggatgtatcaggctataagactgcactgcataaatggatcgatttttgcaaggaattcttgcgttgttatcggaatacggaaatttttacattccatttcaaagacactaaagagtatgagtcgttggacgaatttctgaaggaggtggactcctctgggtatgaaatttcttttgacaagattaaagcatcgtatattaatgagaaggtaaacgcaggggagctgtatctgtttgaaatttacaacaaagatttttcggaatactcaaaaggcaaaccgaacctccatacaatctactggaagtcactttttgagacacaaaacttgctggataaaacagccaaattaaacggcaaagcggaaatcttctttcggcctcgtagcattaaacataatgataaaattatccaccgcgcaggcgaaacgttgaagaataagaatcctctcaatgaaaagccatccagccgctttgactacgatattacaaaggatcggcgttttacgaaagataagttctttcttcactgtccaattaccttgaatttcaaacaagacaagcctgtccgctttaacgaacaggttaacttgtacctgaaggacaatcctgacgttaacattattggtatcgatcgtggcgagcgccacttattatattataccctcatcaatcaaaacggcgaaatcttgcagcagggtagcttgaaccgtattggggaagaagaaagtcgtcctacagactaccatcggctgctcgacgagcgggaaaagcaacgccaacaggcgcgcgaaacttggaaagcggtggagggcattaaggacttgaaggccgggtatcttagccgtgtggttcataagttagctggcttgatggtacagaataacgcgattgtggtgttagaggacctcaacaaagggtttaagcgtggccggttcgccgtggagaaacaggtatatcaaaactttgagaaggcattaattcaaaaactgaactatcttgtctttaaggaggtcaacagcaaggacgcaccgggtcattatctgaaagcatatcagctcaccgcaccattcatctcatttgagaagttaggcactcagtcagggttcctgttttatgtgcgcgcctggaacacaagtaagattgatccggccaccggtttcactgatcaaatcaagccaaagtataaaaatcagaaacaggcgaaggattttatgtcttcatttgactccgtccggtataatcggaaggaaaattattttgagtttgaggcggattttgagaaacttgcgcaaaaaccaaaaggtcgtacccggtggacgatctgctcctatggccaagagcgctactcctacagcccgaaagaacggaagttcgtgaaacacaacgtcactcagaatttagctgagttattcaactcggagggtatcagttttgactcggggcaatgttttaaggacgaaattttgaaggtcgaagacgcttctttctttaaaagcattattttcaatttgcgcctcctcttgaagttgcgtcatacctgtaaaaatgctgagattgaacgggacttcattatctctccggttaaaggtaataattcgtccttctttgatagtcgcatcgctgaacaggagaatattacatctatcccacagaacgcggacgccaacggggcctataatatcgccctgaaagggttgatgaatcttcataatatcagtaaagacgggaaagctaagcttatcaaggacgaggactggattgagtttgtgcagaagcgcaagtttggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1030 - DNA, 4122 bp, synthetic construct
  misc_feature 1..4122: note = Description of Artificial Sequence: Synthetic polynucleotide
  source 1..4122: mol_type = other DNA
atgggccaccatcatcatcatcatagcagcggcctggtgccgcgcggcagcggtaccatgaaggaatttactaaccaatacagtctcaccaaaaccttgcgttttgaacttcgcccagtcggcgagacagctgagaaaatcgaggatttcaagtcgggggggttaaaacagactgtagaaaaagaccgcgagcgcactgaggcctataagcagttgaaggaggttattgattcgtaccatcgggattttatcgaacaggcgtttgcgcggcaacagacgttgtctgaggaagatttcaagcaaacgtaccagttatacaaagaagcccagaaagaaaaggacggcgagacgttgactaagcagtatgaacatctgcggaagaagatcgctgctatgtttagcaaggccacgaaagagtgggctgtaatgggggagaataacgagctgatcggcaagaacaaggaatcgaaattgtaccagtggcttgaaaagaattatcgggcaggccggatcgaaaaggaagaattcgatcataacgcaggcttgattgaatactttgaaaaattcagtacctattttgtggggttcgacaaaaaccgtgcaaatatgtatagcaaggaggcaaaggctacagctatctcgtttcgtacgattaatgaaaacatggtaaagcacttcgataactgccagcgccttgagaaaattaagagcaaatatcctgatcttgccgaggagttgaaggacttcgaagaattctttaaacctagctattttatcaactgtatgaatcaatcagggattgattattataatatttccgcgattggtggcaaagatgaaaaggatcagaaagcaaatatgaaaattaatctcttcactcaaaaaaatcacctcaaggggtccgataagccaccttttttcgcgaaactgtataaacagattttatcggaccgggaaaaaagcgttgtcattgacgagttcgaaaaagactcagaattgactgaggcactcaagaatgttttctctaaggatgggctcattaacgaagagtttttcacgaagttaaagtctgcactcgagaacttcatgttaccagagtaccaaggtcagctctatatccggaacgcattcttaaccaagatttcagctaatatctggggctccgggagctggggcatcatcaaggacgccgttacacaggctgctgaaaataatttcacgcgtaagtcagataaagaaaagtatgctaagaaggacttttactcaatcgcggaactccagcaagcgatcgatgaatacattccgactttagagaacggggtacaaaacgctagcctcatcgaatatttccggaagatgaactacaagccgcgcggctctgaggaagatgctgggctcatcgaagagatcaataataacttacgtcaggctgggattgttcttaatcaagcggagttaggttcaggtaaacagcgtgaggaaaatattgaaaagattaaaaatttgttagactctgtcctcaatcttgaacgctttctgaagccattatacttggaaaaagaaaagatgcgtccgaaggccgcaaatctgaacaaggacttctgcgagtcctttgacccgctttatgagaagctgaagacgtttttcaagctttacaacaaggtgcgtaattacgccacaaaaaaaccgtactctaaagacaaattcaagatcaatttcgacacggcgactctgttatatggttggtccttagataaagaaactgctaacttgtccgtaatcttccggaaacgcgaaaaattttatttagggatcattaatcgctacaactcacagatttttaattacaaaatcgcaggtagcgaaagtgaaaagggcctcgagcggaagcggtctctccagcagaaagtgctggccgaggagggggaagactacttcgaaaagatggtgtatcacttacttctgggtgcaagtaagacaatcccgaaatgttcaacgcaactgaaggaagtaaaagcgcactttcagaaatctagtgaggactatatcatccagagtaaatcttttgcaaagtccctgactcttactaaggaaatctttgatttgaacaatttgcgctataatactgagacgggcgagatttcgtccgagttgtccgatacgtatcctaaaaaatttcagaagggctacttgacccaaacgggggatgttagcggttataaaactgcgttgcataaatggatcgatttttgcaaagagttccttcgctgctatcggaataccgagattttcacttttcatttcaaagacacgaaagagtacgaatctctggacgaattcttgaaagaagtagactcatctggctatgagatttcgtttgataagattaaagcctcttacattaatgagaaggtaaacgcaggggaactgtacctctttgagatctacaacaaggatttctccgaatattctaagggcaaaccgaaccttcatactatttattggaaatctctcttcgaaacccaaaacttgctcgataaaacggcaaaacttaacggcaaggccgagatttttttccggccacgttcgattaagcataacgacaagatcattcaccgggcgggtgaaacgctcaagaacaagaacccattaaatgagaaaccgtcatcgcggtttgactatgacatcacgaaggaccgtcgttttacgaaagacaaattctttctgcattgcccaattaccctcaatttcaagcaggataagccagtacgtttcaacgagcaagttaacttatacttgaaagataacccagacgtcaacatcattggcatcgatcgtggcgagcgtcatctgctctattatactctgatcaaccagaatggcgaaatcttgcaacagggcagcctgaatcggattggcgaagaagagtcgcgcccaaccgactatcatcggcttcttgacgagcgggagaaacaacgccaacaagcccgtgaaacatggaaagcggtcgaaggtatcaaggacttgaaagctggttatctgtcgcgcgttgtacataagcttgccggtttgatggtacagaacaacgctattgtggtgctggaggacttaaacaaaggctttaagcgtggtcggttcgctgtggaaaagcaagtctaccagaactttgagaaagcgctcatccaaaaattgaactacttggtgtttaaagaggttaactcgaaggatgctcctggtcattatcttaaagcgtaccaattaaccgccccttttatttccttcgaaaaactgggtactcagtctgggttccttttctacgtacgtgcctggaatacatcaaagatcgacccagccacgggttttaccgaccaaattaaacctaagtataaaaatcagaaacaggcaaaagattttatgagttcttttgacagtgtccgctataaccggaaagagaactattttgagtttgaagcggattttgagaaattggctcaaaagcctaagggccgtactcgctggacaatctgcagttatggccaggaacgctattcttacagtccaaaggagcgcaagtttgtaaagcacaacgtaacacagaacttggctgaattattcaattctgaaggtatcagctttgattcgggccaatgcttcaaagatgaaattctgaaagtcgaagatgccagtttttttaagtccattatctttaacctccggttgctcttgaaactgcgccacacctgtaaaaacgccgaaatcgaacgcgatttcattatctctccggtgaagggcaataacagttcctttttcgatagtcggatcgcagaacaagaaaacatcacctctatcccacaaaatgctgacgcgaacggtgcctacaatattgcattgaaagggttaatgaatttgcataacatttcgaaggatggcaaagcaaaattgattaaggatgaagattggatcgagttcgttcagaagcgtaagttcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1031 - DNA, 4122 bp, synthetic construct
  misc_feature 1..4122: note = Description of Artificial Sequence: Synthetic polynucleotide
  source 1..4122: mol_type = other DNA
atgggccaccatcatcatcatcatagcagcggcctggtgccgcgcggcagcggtaccatgaaagaattcaccaaccagtattcactcactaagacactgcgctttgaattgcgtccggttggcgaaaccgcggagaagattgaagattttaaatcgggtggcttgaaacaaactgtagagaaagaccgggaacgcaccgaggcctacaagcaactgaaagaagtaattgattcctatcatcgcgacttcatcgagcaggcattcgctcggcaacaaactctgtcggaagaagacttcaagcagacttaccaattgtacaaggaagcccaaaaagaaaaagacggggaaaccttgacaaagcaatacgagcacctgcggaaaaaaatcgccgcgatgttcagtaaagcaacaaaagaatgggccgtgatgggggaaaacaatgagttgatcggtaagaacaaagaaagtaaactgtatcagtggttagagaagaactatcgcgctggtcgcatcgagaaggaagagtttgatcacaatgccggtttaatcgagtattttgaaaagttttccacttacttcgtaggcttcgacaagaaccgcgccaacatgtatagcaaggaggcaaaggctacggcgatcagctttcggacgatcaacgagaacatggtcaagcacttcgataattgccaacggttggagaaaattaagagcaagtacccagatctcgcggaagaattgaaagacttcgaagaattcttcaaaccatcttacttcatcaattgcatgaatcaatcaggcattgactactataacatctccgcgattgggggtaaagacgaaaaggaccagaaagccaatatgaaaatcaatcttttcacacaaaaaaaccacctgaaaggctcagacaagccaccgttctttgcaaaactctacaaacaaatcttatctgatcgcgagaagtccgtggtgatcgatgaattcgaaaaggatagtgaacttacggaagccctgaagaacgtcttctctaaagacggtttaatcaatgaagagttttttactaagttgaagtctgcgttagaaaacttcatgcttccggaatatcagggtcagttatatattcggaacgcgttcttgaccaagatctctgcgaatatttgggggagtggctcgtggggcattatcaaggatgcagttactcaagcggcggagaataatttcacccgtaagagcgacaaagagaagtatgcgaagaaggacttttacagcattgcggaattgcagcaggcgatcgatgagtacattccaactctcgaaaacggcgtacagaacgcgagtttgattgagtatttccgcaagatgaattataagcctcggggttcagaggaggacgctggtttgatcgaggaaatcaataacaatttacgtcaggccggcatcgtgctgaaccaggcggagttaggcagtgggaagcaacgggaagagaatattgagaagatcaaaaacctcttggactctgttcttaaccttgaacgtttcctgaaacctttgtacttggaaaaagaaaaaatgcgtccgaaagccgccaatttgaataaggatttctgcgagtcgttcgacccgttatatgaaaagctgaagacattcttcaaattatacaataaggtgcgtaactacgccaccaagaagccttacagcaaagataaatttaaaatcaatttcgatacggctacactgttgtatggttggagtctggacaaggaaacagcaaatctcagtgtgatctttcggaaacgggagaaattctatcttgggattattaaccgctataattctcaaatctttaactacaaaatcgctggttcagaatcagaaaagggtcttgaacgcaaacgtagcttacagcaaaaagtcctcgcggaagagggggaggattacttcgagaagatggtctaccaccttttgctgggcgcatcaaaaacgattcctaaatgttctacgcagttgaaggaggtgaaggcacatttccaaaagagttctgaggactacattattcaatccaaatcgtttgccaaatctttaactctgaccaaggaaatctttgacttaaataatttacgctataatactgaaactggcgaaatttctagtgagctctccgacacctatccgaaaaaatttcagaaaggttacttgactcaaacgggcgatgtcagcgggtacaagacagcacttcacaaatggattgacttctgcaaggaattccttcgttgctatcgcaatacagaaatttttacatttcatttcaaagatactaaagagtatgaaagtttggatgaattcctgaaggaagtcgatagttcggggtatgagatcagttttgacaagattaaggcatcatacatcaatgaaaaggtgaatgcgggcgaattatatctgttcgaaatctacaacaaagacttctccgaatattcgaaaggcaaaccgaatcttcacactatttactggaagtccttattcgaaacgcaaaaccttctcgacaagacagctaaattaaatgggaaagctgagatcttctttcggccacggtcgatcaaacataacgacaaaattattcaccgggctggcgagacattaaagaataaaaacccgcttaatgaaaagccttcctcgcggttcgattacgacattactaaagaccgccgcttcactaaggacaagtttttcttgcattgtccgattacattgaacttcaaacaggacaagccagtgcggtttaatgaacaggttaacctgtacctcaaagataaccctgacgtgaatatcattgggatcgatcgtggtgaacgtcacctcttatactatactctcatcaaccagaacggtgaaatcttacaacagggttcactcaaccgcattggcgaggaggagtcacgtccaacagactatcaccggctgctcgacgagcgggaaaagcagcgccaacaagcacgtgaaacttggaaggcagtcgagggtattaaagatctgaaagcaggttatttatctcgtgtcgtacataaattggctggcttgatggtacaaaacaacgccattgtagtcttggaggatttaaacaaaggttttaagcgtgggcggtttgctgtagagaaacaggtttaccagaacttcgaaaaagctctcattcaaaaacttaactacctcgtattcaaagaggtcaactccaaagacgccccaggtcactacctgaaggcatatcaactgacggcccctttcattagctttgaaaagttgggtactcaatctggctttctcttttatgttcgggcctggaacacctccaaaatcgatccggcaactggcttcacggaccaaattaagccaaaatacaaaaaccaaaagcaagctaaggacttcatgtcatcgtttgactcggttcggtacaaccggaaggaaaactacttcgaatttgaagcagatttcgagaaattggctcagaagccaaaaggccggacgcgctggactatctgttcttatggccaggagcggtactcttatagccctaaagagcggaagtttgttaagcataatgtaacacaaaacttggcagagctcttcaattcggaagggatctccttcgatagcgggcaatgcttcaaggatgagattttaaaagttgaagacgctagtttcttcaagtccatcatttttaaccttcggctgcttctcaaacttcggcacacatgcaagaatgctgaaattgaacgggactttattatttctccggttaagggcaataatagctcattctttgacagtcggatcgcagaacaggagaatatcacctctatccctcaaaatgccgatgcaaatggtgcatacaatatcgcccttaaagggcttatgaacttacacaatattagtaaagacgggaaggccaagctcattaaggatgaggattggatcgagtttgtacaaaaacggaaattcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1032 - DNA, 4122 bp, synthetic construct
  misc_feature 1..4122: note = Description of Artificial Sequence: Synthetic polynucleotide
  source 1..4122: mol_type = other DNA
atgggccaccatcatcatcatcatagcagcggcctggtgccgcgcggcagcggtaccatgaaagagttcacgaaccagtactctttgactaagacacttcggttcgaactccggccggtgggtgaaaccgctgagaagatcgaggattttaagagtggggggttgaaacaaacagtagagaaagaccgtgaacggaccgaggcctataagcagcttaaggaggttatcgactcttaccaccgtgattttattgaacaggcttttgcccgccagcaaacattatcagaggaggattttaagcagacctatcaactgtacaaagaagcccagaaggaaaaagatggcgagacgttaacaaagcagtacgagcatttgcgtaaaaaaatcgcagccatgttttcaaaggccacaaaggaatgggctgtaatgggcgaaaataatgagttgattggtaaaaataaagagagtaaattgtatcaatggcttgaaaagaattatcgggccggtcggattgagaaagaggagtttgatcacaacgcggggttaattgagtattttgaaaaattttcgacctactttgttgggttcgacaagaatcgcgccaatatgtattcaaaagaggcaaaggccacggccatctcattccgcactattaacgagaacatggtgaaacacttcgacaactgtcaacggttagagaagatcaagtcgaagtaccctgatctcgccgaggagctcaaggatttcgaggaatttttcaaaccgtcctacttcatcaattgtatgaatcaatctgggatcgattattacaacatttctgcgatcggcggcaaagacgaaaaggatcagaaggcaaacatgaagattaatctgtttacacagaagaatcacttaaaagggagcgacaaacctccttttttcgcaaagctgtataagcagatcctctcagaccgcgaaaagtcggtggtaattgacgaatttgaaaaagatagtgagctcactgaagctctcaaaaatgttttttcaaaggatggtttgattaatgaggagttcttcaccaagctcaagtcagcgctggaaaatttcatgttacctgagtaccaaggtcaactgtacattcgcaacgcctttcttacgaaaatttccgccaacatctggggtagcgggagctggggtattatcaaagacgcagttacgcaagccgccgagaacaactttacgcgcaagagtgacaaagagaagtatgccaaaaaggacttctattccatcgcagaattacagcaagctattgacgagtacatccctacactggagaacggtgtccagaatgcctctctcatcgaatatttccgcaaaatgaactacaagccacgcgggagcgaggaggatgctgggctcatcgaagagattaataacaacttacgccaagcaggtattgttctcaaccaggcggagctcggttcagggaaacagcgggaggagaacatcgaaaaaatcaagaatctcctcgactctgtcttgaacttggaacgctttctgaaaccactctacttggagaaagagaagatgcgtccgaaagcggctaacttaaataaagacttttgcgagagttttgatccattgtacgagaagttgaaaacattttttaaactgtataacaaggtacgtaattatgctacgaagaagccgtactctaaggataagtttaagattaatttcgacacagcgaccctcttgtacggttggtctttagataaagagaccgcgaacctctcggttatcttccggaagcgtgaaaaattctaccttgggatcatcaatcgctacaacagtcaaatcttcaattacaaaatcgcaggcagcgaatccgagaaggggctggagcgtaaacggagtttacaacagaaagtccttgcagaagaaggggaagattattttgagaaaatggtgtaccaccttcttttgggtgcgagtaagacaatcccgaaatgtagcacacagcttaaggaggtgaaagcgcatttccagaaatcgtcggaggattacatcatccaatcaaagtctttcgccaaaagtctgacactcaccaaagaaatttttgacctcaataatctgcgttacaacaccgagacgggggaaatcagttcagaactttcggatacgtacccgaagaaattccagaaaggttacctgactcaaacaggggacgtttctggttataaaacagccctccacaaatggattgatttctgtaaggaatttcttcgttgttaccggaataccgaaatctttacattccattttaaggacactaaggaatatgagagtctggacgagtttttaaaggaagtagattctagtggttatgagatttctttcgataagatcaaagcgtcctatattaatgagaaagtgaacgccggcgaattatatctttttgagatctataataaggattttagtgaatattcgaagggcaaacctaatctgcatacaatctattggaaatcgttattcgaaacccagaatttactggataaaactgccaaattaaatggcaaagcagagatttttttccgccctcgttcgattaaacacaacgacaaaatcattcaccgcgcaggcgaaaccttaaaaaataagaatccattaaatgaaaagccttcctcacgcttcgactacgacatcacaaaggaccgtcgttttactaaggataagttttttctgcattgtccaattaccctgaatttcaagcaagacaagccggttcgctttaatgaacaggtgaatttatatcttaaggataaccctgacgttaacattattggtattgatcgtggggagcggcatctgctgtattacacactgattaatcagaacggggaaattcttcaacaaggttctctgaaccgtatcggtgaagaggaatcccggcctacagactatcatcggctgttagacgaacgggaaaaacagcgtcagcaggcgcgggagacttggaaagccgttgaagggattaaggatttgaaagccggctatttgagtcgcgtcgtccacaaattagcagggctgatggtacagaacaatgccatcgtagtgttggaggatcttaataaggggttcaagcggggtcgttttgctgttgaaaagcaggtgtaccagaatttcgagaaagctcttattcaaaaacttaactatctggttttcaaagaagttaactccaaggacgcaccaggtcactatcttaaggcgtaccagcttactgcgccgttcatcagtttcgagaagctcggcacgcagtcggggttccttttttatgtgcgcgcttggaacacctccaagatcgatcctgctacaggtttcacggatcagattaagccgaaatacaagaaccaaaagcaggcaaaagatttcatgtcaagcttcgactctgttcgttacaatcggaaggagaactatttcgagttcgaagccgacttcgaaaaactggcccaaaaaccgaaaggccgtacacgctggacaatttgttcctacgggcaagagcgttattcgtactcaccaaaagagcggaagttcgttaaacacaatgtcacgcaaaatttagccgaattgttcaactccgaaggtatcagcttcgactcagggcagtgtttcaaggacgagattttgaaagtcgaggacgcgtcgttttttaaatccattatttttaatcttcgcctcctgttgaagttgcggcatacgtgcaaaaatgccgagatcgaacgggattttatcatcagcccggtaaagggcaacaactcaagcttctttgactcccggatcgccgaacaagaaaatattacttcgatccctcaaaacgcagacgcaaacggtgcatataatatcgccttgaaaggtttgatgaatcttcacaatatctcaaaggacggtaaggctaagttgattaaggacgaagattggatcgaatttgtacaaaaacgtaaatttggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1033 - DNA, 4122 bp, synthetic construct
  misc_feature 1..4122: note = Description of Artificial Sequence: Synthetic polynucleotide
  source 1..4122: mol_type = other DNA
atgggccaccatcatcatcatcatagcagcggcctggtgccgcgcggcagcggtaccatgaaggagtttaccaatcaatattcgttgacaaaaaccttacgttttgagttacgtccagtaggggagactgccgaaaagattgaggatttcaagagcgggggtctgaagcaaacggtggaaaaagaccgtgaacgcactgaagcttacaagcagcttaaggaggtgattgatagctaccatcgggactttattgaacaggccttcgcgcgtcaacagactctttcggaagaagattttaagcaaacgtaccagttatacaaagaggcccagaaagaaaaggacggggagactctgaccaaacagtatgagcatcttcgcaaaaagatcgcggctatgttctcaaaggccaccaaagagtgggcagttatgggcgagaacaatgagttgatcggtaaaaataaagaaagcaagttatatcagtggttagaaaaaaattaccgtgctggtcgcattgagaaagaggaattcgaccataatgccgggttaatcgagtacttcgagaagttctcaacttacttcgtcgggtttgataaaaaccgcgctaacatgtatagtaaggaggccaaggccaccgccatttccttccggaccatcaatgaaaacatggtgaagcatttcgacaactgtcagcggttggagaaaatcaaaagcaagtatcctgatttggcggaagagttgaaggattttgaagaattttttaagccaagctatttcatcaactgtatgaatcagtctgggatcgactattataacatcagcgccattggtgggaaagacgaaaaggaccaaaaggcgaatatgaagatcaatctttttacacaaaaaaaccacctcaaggggtctgacaagcctccattctttgcaaaactctataaacaaattctctcggaccgggaaaaatctgtagtgatcgatgaattcgaaaaagattccgagttgaccgaagcgcttaagaatgtcttttccaaagatggcttaatcaatgaagagttttttactaagttgaagtccgctttggaaaattttatgctgcctgaatatcaagggcaattgtacattcgtaacgctttcctgacaaaaatcagcgcgaacatttggggttccgggtcctgggggattattaaggatgcagtgacccaagccgcagagaacaattttacacgcaagagtgataaggaaaaatatgctaagaaagatttttacagtatcgcggaattacaacaggctatcgatgaatatattcctaccttagagaatggggtacagaacgcctctcttatcgagtatttccgcaaaatgaactacaagcctcgtggttcagaggaggatgctggccttatcgaggagattaataataatctgcgtcaagccggtatcgtgctcaaccaggcggagctgggctcgggtaagcagcgcgaagaaaatattgagaagattaagaatcttttggactcggtgctgaacttggagcgttttcttaaaccgctttatctggaaaaggagaaaatgcggcctaaagcggcaaacctgaacaaagatttctgtgagagttttgacccactgtatgagaagctgaagacgttctttaagctctacaacaaggtgcgcaattatgcgaccaagaaaccgtattcgaaagataaattcaaaattaattttgacacagccacgcttctctacgggtggtctttggataaggagacggccaacttatcggtgatcttccgtaaacgggaaaaattctatcttggtattatcaatcggtacaactcccaaatttttaattataagatcgcaggcagcgagtctgaaaaaggcctggagcgcaaacgctctttacaacagaaggtccttgcggaggagggcgaggactacttcgagaaaatggtttaccatctgctgcttggggcatccaagaccatcccaaagtgttccacccagcttaaggaggtcaaagctcacttccaaaaaagctcggaagattacattatccagagcaaatcgttcgccaaatcattgacattgacaaaggaaatcttcgaccttaataacctccggtataatactgaaactggtgaaatttcttccgaactcagcgacacatacccgaaaaagttccaaaaggggtacctgacccagactggcgacgtctctggctacaaaacggcattacacaagtggatcgatttctgtaaagagtttcttcgctgttaccgcaacacagaaattttcaccttccatttcaaagacacaaaggagtatgagtctctggacgagtttttaaaggaggtggacagcagcggctacgaaatctccttcgataagatcaaggctagttatattaatgagaaggtcaatgcaggtgagttgtacctgtttgaaatttataacaaagatttttctgaatattcaaagggcaaaccgaacctccacacgatttattggaagtcgcttttcgagacgcagaatttgttggacaaaactgctaagttgaacgggaaagcagaaattttcttccgtccgcgttcaattaagcacaacgacaaaattatccaccgggccggtgaaacactcaagaataagaacccgcttaatgaaaagccttcctctcgtttcgattatgacattactaaagaccggcggtttacgaaggacaagttctttcttcactgcccaatcacgctcaactttaagcaagataagccggttcgtttcaatgaacaagtcaacttatacctgaaggataatccggacgtgaacattattgggattgatcgcggggagcgtcatctcttatactatacattaattaaccaaaacggcgaaatcttgcagcaaggttcgctgaatcgcatcggggaagaagagtctcgcccgactgattaccatcgtcttcttgacgagcgggagaaacaacggcagcaggcgcgcgaaacctggaaggccgtcgaagggatcaaggatttgaaagctggctatctgagtcgggtggtgcacaaacttgcaggtttgatggtccaaaacaacgctatcgtggtgctcgaagaccttaataaggggtttaaacgtgggcggttcgcggtagagaagcaggtgtaccagaacttcgaaaaagcactgattcagaagttaaattacctggtatttaaagaggtgaattccaaggatgccccaggtcattacctgaaggcttaccaattgacagcgccgttcatttctttcgagaaactcgggacgcagtcaggcttcctcttctatgtacgcgcgtggaacacgtcaaaaatcgacccagctacagggtttaccgaccaaattaaaccaaagtacaagaaccagaaacaagcaaaagatttcatgtcttcctttgactccgttcgttacaatcgcaaggaaaactatttcgagttcgaggctgattttgagaaactggcccaaaaaccgaaaggtcgcactcgttggacgatttgctcgtacggtcaagagcgctatagctattcaccaaaggagcggaagttcgtaaagcacaatgtgacgcagaatttggccgagctttttaactcggagggtatctctttcgatagtggtcaatgtttcaaggacgagatcttaaaggtcgaagacgctagtttcttcaagtccatcatcttcaatttacgcttactcctcaaattgcgccatacgtgcaaaaatgccgaaatcgagcgcgacttcattatttcacctgttaaagggaacaactcctctttcttcgatagtcggattgctgaacaagaaaacattacaagtattccgcagaacgccgatgcaaacggggcgtataatatcgccttaaaagggttgatgaacttacataacatttcgaaagacgggaaggctaaacttattaaggacgaagactggatcgagtttgtacagaaacgtaagttcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1034 - DNA, 4122 bp, synthetic construct
  misc_feature 1..4122: note = Description of Artificial Sequence: Synthetic polynucleotide
  source 1..4122: mol_type = other DNA
atgggccaccatcatcatcatcatagcagcggcctggtgccgcgcggcagcggtaccatgaaggagtttactaatcaatacagcctcactaaaactctccggtttgagctccggcctgtaggcgagaccgcagaaaaaatcgaagatttcaagtctggcgggctcaaacagacggttgaaaaagatcgcgagcgcactgaggcctacaaacagttaaaagaggtgattgactcctaccatcgggattttatcgagcaagccttcgctcggcaacagactttgtccgaagaggattttaagcagacgtaccagctctataaagaagcacaaaaggaaaaggatggtgagaccttgacaaaacagtacgaacatttacggaagaagatcgcggcgatgtttagcaaggccactaaggagtgggccgtaatgggcgagaataatgaacttattgggaagaacaaagaaagtaagctctaccaatggctcgagaaaaactatcgcgcaggtcggattgaaaaagaggagtttgaccataatgccggtttaatcgagtattttgagaaattctcgacttactttgtgggtttcgataagaaccgtgcgaacatgtactcaaaggaagcaaaggctactgcaatctcgtttcggacaatcaatgaaaacatggtaaaacattttgacaattgccaacgcctcgagaagattaagtccaagtaccctgatttggccgaggagcttaaagatttcgaggagttcttcaaacctagctactttatcaactgtatgaatcaatcagggattgattattataacatctccgccattggtggtaaagacgagaaagaccagaaggctaatatgaaaatcaatctgtttacgcagaagaaccatcttaagggttccgataaaccacctttcttcgccaaattatataagcaaatcttaagcgatcgtgagaaatcagtagtcatcgatgagttcgagaaggacagtgagctgaccgaggcgctcaaaaacgtgttctccaaggatgggttaatcaatgaggagttttttaccaagctcaagtctgcgttggaaaattttatgctcccggagtatcaaggccagttatacatccgtaacgcgtttttaaccaagatctcggctaacatttggggttctggtagctggggtattatcaaggatgcggtgacacaggctgcggaaaataattttacacgtaagagtgacaaagaaaaatatgcgaaaaaggatttttactcaattgctgagctgcaacaagctattgatgaatacattcctactcttgagaacggcgtgcagaacgcgtctttaattgagtatttccgcaaaatgaactataaaccgcgtggctcagaagaggacgcaggcttaattgaagaaatcaataataacttgcgccaagcgggcattgttcttaatcaagccgagcttggcagcgggaagcagcgtgaggagaacattgagaaaatcaaaaatttgctggatagtgtattgaatttggaacgctttctgaagccgctgtatttggagaaagaaaaaatgcgtccaaaggctgcgaacctgaataaggatttttgcgagagctttgacccgctctacgagaagcttaaaacgttcttcaagctgtataacaaggtacggaattacgcaactaaaaaaccttatagcaaagacaagttcaagatcaactttgacactgccacattactctatggttggagtcttgataaggaaactgcaaacttgtctgtcatttttcgtaaacgcgagaagttttatctgggcatcattaaccggtacaactcacaaatctttaactacaagatcgccggcagcgaatcggaaaaaggtctggagcgtaaacgcagtcttcagcagaaagtgttggccgaggagggcgaggattacttcgagaaaatggtgtaccatcttttattaggcgccagcaagacgattccgaaatgtagtacgcaactcaaagaggtaaaggcccactttcaaaaatcgagtgaggactacatcattcaatccaagagtttcgcgaagagcttgacattaacaaaggaaatctttgacctgaataacttgcgctacaataccgagactggcgagatttccagtgagctgtcggacacatatccgaaaaaattccagaaggggtatctgacgcaaacgggggacgtctcagggtataagaccgccctccacaagtggattgatttttgcaaggagttcttgcgttgttaccgtaacacagaaattttcacatttcactttaaagatactaaggaatacgagtccctggatgagtttttgaaagaagtagatagttccgggtatgaaatctcatttgataagattaaggcatcatatattaatgagaaagttaacgccggcgagttgtatttatttgaaatttacaataaggactttagtgagtatagcaaggggaaacctaatttacatacgatttattggaaaagtttgtttgaaacccaaaacctcctggataagaccgccaagttgaacggcaaggcggaaattttctttcgtccacgtagcattaaacataatgacaaaatcattcaccgtgcgggcgagaccttgaaaaacaaaaatccattgaatgaaaaacctagctcccgcttcgactacgacattactaaagaccggcggttcacaaaagataagtttttcttacattgccctatcacattaaattttaagcaggacaagccggtccgtttcaacgagcaagttaacttgtaccttaaagacaatccggatgtaaacatcattggtatcgatcgcggcgaacgccacctgctctactacaccctcattaatcagaacggtgagatcctccaacaggggtctctgaatcgcattggggaggaggaatcacggccgactgactaccaccggctcttagacgaacgggaaaaacaacgtcagcaggcgcgggagacatggaaagccgtagagggtatcaaggatcttaaggcaggctatcttagccgggttgtacataaattggctggtctgatggtccaaaacaacgctatcgttgtacttgaagatcttaacaaagggttcaagcgcggccgtttcgccgtagaaaaacaagtataccaaaacttcgagaaggcacttattcaaaagctgaactatttagttttcaaggaggtcaactcgaaagacgcaccaggtcattatcttaaggcctatcaactcaccgcgccatttatttcgttcgagaagctgggcacgcagagtgggtttttgttttatgtgcgtgcgtggaatacgtcgaaaatcgatccggcgacaggcttcaccgatcaaattaagccgaaatacaaaaatcagaaacaagcgaaagactttatgtcatcctttgattcagtccggtacaatcggaaagagaactattttgaatttgaggcggacttcgagaaactcgcacaaaagccaaagggccgcacgcggtggaccatttgcagctatggtcaagagcgctatagttacagtccgaaggaacggaagttcgtcaaacacaacgtcacgcagaacttagcggaactcttcaattctgaagggatctcgtttgactcggggcaatgttttaaggatgagatcctcaaagttgaggatgcgagcttcttcaagagtattattttcaatttacgtttacttcttaagctgcgtcacacatgcaaaaatgcagaaattgagcgtgacttcatcatttcacctgttaaaggcaacaactccagtttttttgactctcgtattgccgagcaagaaaacattacctcaatccctcaaaacgcggacgctaatggcgcgtacaacatcgcattaaagggccttatgaatcttcataacatttctaaggatgggaaggcgaaacttatcaaggatgaagattggattgagtttgtacaaaagcgtaagttcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1035 - DNA, 4122 bp, synthetic construct
  misc_feature 1..4122: note = Description of Artificial Sequence: Synthetic polynucleotide
  source 1..4122: mol_type = other DNA
atgggccaccatcatcatcatcatagcagcggcctggtgccgcgcggcagcggtaccatgaaagaattcacgaaccagtacagcctcacgaaaactctgcgcttcgaacttcgtccagtaggtgagactgccgaaaaaattgaggactttaagtcaggtgggctcaaacaaacagtagagaaagaccgtgagcgcactgaggcttacaaacaactcaaggaagtaattgactcgtaccaccgcgatttcattgagcaggcctttgcccgtcagcaaactctgtctgaggaggattttaagcaaacctaccaattgtataaagaagcgcagaaagagaaagatggtgaaacgctgaccaagcagtacgagcatttacggaaaaagatcgcggctatgttctcaaaggctacgaaggagtgggccgtgatgggggaaaacaacgaactcatcggcaaaaacaaggagtcaaagctttatcagtggttagagaagaactaccgggcgggtcgtatcgaaaaagaggaatttgaccacaacgcagggcttatcgagtactttgagaaattttcaacgtatttcgttggtttcgataagaatcgtgcgaacatgtatagcaaggaagccaaagcaaccgctatttcgttccggactatcaatgaaaatatggtaaagcattttgacaactgccaacgtcttgaaaagatcaaatcgaagtacccggatttggcggaggagttgaaagacttcgaggaattcttcaagccgtcctactttatcaactgcatgaatcaatcaggcattgactactataacatctccgcgattgggggcaaagacgagaaggaccaaaaggcgaacatgaagattaacctgtttacacaaaagaatcatttaaagggttcagacaagccacctttctttgctaagttgtacaagcaaattttgagtgaccgtgaaaaatcggtagtgatcgatgagttcgagaaagactccgagctcaccgaggctcttaaaaacgtcttctcgaaagatggcttaattaacgaggaattcttcaccaaattaaaatctgcgctggaaaactttatgctcccagaataccaaggtcagttatacatccggaatgctttcttgactaagattagtgcgaatatttggggttcgggttcctgggggattatcaaagatgctgttacgcaagcagctgaaaataactttacccgcaaaagtgataaagaaaaatacgcgaaaaaagatttctactccatcgcagaactccagcaagcaattgatgaatacatcccgaccctggagaatggcgtacagaatgcgagtcttattgagtacttccggaagatgaactataagccgcggggctcagaggaagatgctggtctgatcgaggaaatcaataacaacttgcggcaggcagggattgttttaaaccaagctgaattaggtagcggcaaacagcgtgaggagaatatcgagaaaatcaaaaatttattagattccgttctcaacctggaacgttttttaaagccattgtatctcgagaaggagaagatgcgcccaaaggcggcgaatctgaataaagatttctgcgagagcttcgatcctctctacgagaaactcaagacattctttaaattgtataacaaggtccggaattatgcaaccaaaaagccatattccaaagataagttcaaaattaatttcgacaccgctactttgttgtacgggtggagccttgacaaagagaccgcgaatctttctgttatcttccgcaaacgggaaaagttctatctgggtatcatcaaccgttacaactcgcaaattttcaattacaaaatcgccgggagtgaatctgaaaaaggtctggagcgcaagcgttctcttcaacagaaagttttagcggaggaaggcgaagattattttgaaaaaatggtgtaccacttactcctgggtgcatcaaaaacgatccctaaatgcagtactcaattaaaggaggttaaggcccactttcagaagagtagcgaagattacattattcaatctaaatcgttcgccaagtctttgacacttactaaggagatcttcgatcttaacaacctccgctataacacggagactggcgagatcagcagcgagctgagtgacacgtaccctaaaaaattccaaaaggggtacttgacacaaacgggggatgtgtccggttacaaaacggctctccacaaatggattgacttctgcaaggagttcttgcggtgctatcgcaatacggagatcttcacgttccactttaaggacacaaaggagtacgagagcctcgatgagttcctgaaagaggtggactcttcggggtatgaaattagcttcgacaaaattaaggcctcgtacatcaatgagaaggtaaatgccggcgaactgtatctttttgaaatctataacaaggatttcagtgagtattccaaggggaaaccgaatctgcatacgatctactggaagagtctttttgaaacccagaaccttcttgataagaccgcaaagttaaacggcaaagccgaaatcttctttcgcccgcgctcaattaagcacaatgacaagattattcatcgtgctggtgaaacattgaagaataagaatccattgaacgagaagccatcgtctcggttcgattatgacatcaccaaggatcgccgctttacgaaagacaagttttttctccattgtcctatcacgctgaatttcaagcaggataagcctgttcgcttcaatgagcaggtaaacctgtatcttaaggacaaccctgatgttaatattatcgggattgatcgcggggaacggcacctgctctattataccttaatcaatcaaaacggggagattcttcagcaggggtcgttgaatcgtatcggcgaagaggaaagccgcccgacggactaccaccgcctcttagacgagcgtgaaaagcagcgtcaacaggcccgcgagacctggaaagccgtagagggtatcaaagacttaaaggcagggtatttgtcacgtgttgtgcataagctcgcgggtcttatggtgcagaataatgccattgttgtgttagaagatcttaacaagggctttaaacgcgggcggttcgctgtggagaagcaagtatatcagaactttgagaaggctttgattcagaaattgaactatcttgtatttaaggaggttaattcgaaggacgcgcctgggcactatcttaaagcatatcagctgactgcaccttttatcagcttcgagaagttagggacccaaagcggctttctgttttacgtccgcgcttggaatacctcaaaaattgaccctgctacaggttttacggatcagatcaagccaaagtacaagaatcagaagcaggccaaggactttatgtcatctttcgacagtgtccgctataaccgtaaagaaaactatttcgagttcgaagcagacttcgaaaagttggcccagaaaccaaaggggcgcactcgttggacaatctgctcttacgggcaggaacggtattcttatagtccgaaggagcggaagtttgtcaagcacaacgtcacgcagaacctcgcagagctgtttaacagcgaagggatttcgtttgactcgggccagtgcttcaaagacgagatccttaaagttgaggacgctagcttcttcaaatcgattatcttcaacttgcgtttgttgcttaagttgcgtcatacgtgcaagaatgcagagattgagcgtgatttcatcatctccccggttaaaggcaacaacagctccttctttgactcacgtatcgccgagcaagagaacatcacgtcgattcctcagaacgcggacgcaaatggtgcgtacaacattgcgcttaagggtctcatgaaccttcataacatctctaaagatggtaaggcgaaacttattaaggacgaagactggatcgaatttgtgcaaaagcgtaagttcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1036 - DNA, 4122 bp, synthetic construct
  misc_feature 1..4122: note = Description of Artificial Sequence: Synthetic polynucleotide
  source 1..4122: mol_type = other DNA
atgggccaccatcatcatcatcatagcagcggcctggtgccgcgcggcagcggtaccatgaaagaattcactaatcagtactccctcactaagacactgcgcttcgagctccggccagtaggtgaaaccgcggagaaaatcgaggatttcaaaagcggcggcctcaaacagacggtcgaaaaagaccgtgaacgcaccgaggcctacaagcaacttaaggaagtgattgacagttaccatcgggattttatcgaacaggcattcgcacggcaacagacgctgtccgaggaggacttcaagcaaacctaccagctgtataaagaagcgcagaaagagaaggacggtgagaccttgaccaagcaatacgagcatctgcgcaagaagattgcggcaatgttctcaaaagcaactaaggagtgggccgttatgggcgaaaataacgagctcattgggaaaaacaaagaatccaaattatatcaatggttggagaaaaactatcgcgcaggccggattgaaaaagaagaatttgatcacaacgctggtcttattgaatattttgaaaaattctccacttatttcgtaggctttgacaagaaccgggcgaacatgtactccaaggaggcaaaggctacggccatctcgtttcgcaccattaacgaaaatatggtcaaacatttcgataactgccagcgtctcgaaaaaatcaagtcgaaatacccagacttagcagaagaactgaaggatttcgaggagtttttcaaaccaagttattttatcaactgcatgaaccaaagcgggattgattattacaacatctcagcgatcgggggcaaggatgaaaaagatcaaaaagccaatatgaagatcaacttgtttactcaaaaaaatcacctgaaaggttccgataaacctccgttctttgctaagctctataagcagatcttaagcgatcgtgaaaagagcgtcgtaatcgatgagtttgaaaaggattcggaattaacggaagcgctgaaaaatgttttttcaaaggacggcctcatcaatgaagaattctttacaaaattaaaatcggcgttggaaaacttcatgttaccagaatatcaaggccagctttatatccggaatgcgttcctgacgaagatcagtgcgaatatttggggcagcgggtcgtgggggatcatcaaggatgcagttacgcaagcagccgagaacaatttcactcggaaaagtgataaagagaagtacgcgaagaaagatttttatagcatcgctgagctgcagcaagcgattgacgaatacatcccgacgttagaaaacggggttcagaatgcctcactcattgaatatttccgtaagatgaattacaaaccacgcggcagtgaagaggacgcggggctgattgaagaaattaacaataatttgcgccaagcgggtatcgtccttaatcaagcagaacttgggtctggtaagcagcgtgaagaaaacattgagaagatcaagaatcttctggattcagttttgaaccttgaacgttttttgaaaccactttatctggagaaggaaaagatgcgtccgaaagcggcgaacctcaacaaagacttctgcgagtcgttcgacccgctctacgagaaattgaagaccttcttcaagttgtacaataaggtccgtaattacgcgactaaaaaaccgtattccaaagataaatttaagatcaactttgacaccgcgaccctcctgtatggctggagtctggataaggagaccgcgaacctttctgtcattttccgtaagcgtgaaaaattctacctcgggatcatcaatcggtataattcgcagattttcaattacaagattgcagggtctgaaagcgaaaagggcctggaacgtaagcgttctttgcagcaaaaagtcttagccgaggaaggggaggactactttgaaaagatggtgtaccaccttttattaggtgcatctaaaactattccgaaatgtagcactcagttaaaagaggttaaagctcactttcaaaaaagtagtgaagactatatcattcaatccaagtcctttgcgaagtcattgactttaacgaaggaaatcttcgatctcaataaccttcggtacaataccgaaaccggcgaaatctccagcgagcttagcgatacatatccgaaaaaatttcaaaaaggctatctcacccaaactggcgatgtgtccggttacaagactgcattgcacaagtggatcgacttttgtaaggaattccttcggtgttatcggaacaccgagatctttacgttccacttcaaagatacaaaggaatatgaatcgcttgacgaattcttaaaagaagtagattcaagcggctacgagatcagctttgataagattaaggccagctacatcaatgaaaaagtcaacgcaggggaattatacctgttcgaaatttacaataaggacttttccgagtattccaaggggaagccgaatctgcatacgatctattggaaatccctgtttgagacccagaacctgttagacaaaacagcgaagctgaatggtaaggcggaaattttttttcggcctcgtagtattaaacacaacgataaaatcattcatcgtgctggcgagactctgaaaaataaaaacccgttaaacgaaaagcctagctctcgttttgactacgatatcacaaaggaccgccgctttactaaagacaaattcttcctccactgcccgattaccttaaactttaagcaggacaagcctgtgcgttttaacgaacaagtaaatctctacctgaaagataatccggacgtaaacatcattggcatcgatcgcggcgagcgccatttgctttattacacgctgattaatcagaacggggagatcttgcaacaggggtcacttaatcggatcggcgaggaagaatcccgtccaacagactaccaccggctgcttgacgaacgggaaaaacagcgtcagcaggcccgtgagacttggaaagcggtcgagggtatcaaggaccttaaggccggttacttgagccgggtcgtacataagcttgcaggcctcatggtccagaataatgcaatcgtggtactcgaggacctgaataaaggttttaagcgcgggcggttcgccgttgagaaacaagtctatcaaaacttcgaaaaagcccttattcaaaaattgaattatttagtattcaaagaggtcaactccaaggatgcaccggggcactatcttaaagcctatcagttaaccgcgcctttcatttcctttgaaaaactggggactcagagcggtttcttattttacgtacgtgcgtggaatacaagcaagattgatcctgcgaccgggttcacggaccaaatcaagcctaaatacaaaaatcaaaagcaagcaaaggatttcatgtcgagtttcgattccgtacggtataatcggaaggagaattacttcgagttcgaagctgactttgaaaagcttgcacaaaagccgaaaggccgtacccgctggactatctgttcgtatgggcaggagcggtatagctacagtcctaaggaacggaaatttgtaaagcataacgtgacgcaaaatttagcagagttgttcaattcggaaggcatctcctttgattctggtcagtgcttcaaggatgagatcttgaaggtggaggatgctagtttcttcaagagcatcatctttaatctgcgtctgttgctcaaattacgccatacgtgcaaaaatgctgaaatcgagcgtgactttattatttcaccggtgaagggtaacaacagtagtttttttgattcacgtatcgccgaacaggagaacatcacgtcaatcccacaaaacgcggacgcgaacggggcttacaatatcgcgcttaaggggctgatgaacttgcataacatctccaaggatggtaaggcaaagttgatcaaagacgaagactggatcgagtttgttcaaaaacgcaaattcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1037 - protein, 1250 aa, synthetic construct
  REGION 1..1250: note = Description of Artificial Sequence: Synthetic Cas12a/Cpf1 [Barnesiella sp. An22] sequence
MKTLSDFTNLFPLSKTLRFKLIPIGNTLKNIEASGILDEDRHRAESYVKVKAIIDEYHKAFIDRVLSDTCLQTESIGKHNSLEEFFFYYQIGAKSEQQKKTFKKIQDALRKQIADSLTKDKHFSRIDKKELIQEDLIQFVRDGEDAAEKTSLISEFQNFTVYFTGFHENRQNMYSPDEKSTAIAYRLINENLPKFVDNMKVFDRIAASELASCFDELYHNFEEYLQVERLHDIFSLDYFNLLLTQKHIDVYNALIGGKATETGEKIKGLNEYINLYNQRHKQEKLPKFKMLFKQILTDREAISWLPRQFDDNSQLLSAIEQCYNHLSTYTLKDGSLKYLLENLHTYDTEKIFIRNDSLLTEISQRHYGSWSILPEAIKRHLERANPQKRRETYEAYQSRIEKAFKAYPGFSIAFLNGCLTETGKESPSIESYFESLGAVETETSQQENWFARIANAYTDFREMQNRLHATDVPLAQDAEAVARIKKLLDALKGLQLFIKPLLDTGEEAEKDERFYGDFTEFWNELDTITPLYNMVRNYLTRKPYSEEKIKLNFQNPTLLNGWDLNKEVDNTSVILRRNGRYYLAIMHRNHRRVFSQYPGTERGDCYEKMEYKLLPGANKMLPKVFFSKSRIDEFNPSEELLARYQQGTHKKGENFNLHDCHALIDFFKDSIEKHEEWRNFHFKFSDTSSYTDMSGFYREIETQGYKLSFVPVACEYIDELVRDGKIFLFQIYNKDFSTYSKGKPNMHTLYWEMLFDERNLMNVVYKLNGQAEIFFRKASLSARHPEHPAGLPIKKKQAPTEESCFPYDLIKNKRYTVDQFQFHVPITINFKATGTSNINPSVTDYIRTADDLHIIGIDRGERHLLYLVVIDSQGRICEQFSLNEIVTQYQGHQYRTDYHALLQKKEDERQKARQSWQSIENIKELKEGYLSQVVHKVSELMIKYKAIVVLEDLNAGFKRSRQKVEKQVYQKFEKMLIDKLNYLVFKTAEADQPGGLLHAYQLTNKFESFKKMGKQSGFLFYIPAWNTSKIDPTTGFVNLFDTRYENVDKSRAFFGKFDSIRYRADKGTFEWTFDYNNFHKKAEGTRSSWCLSSHGNRVRTFRNPAKNNQWDNEEIDLTQAFRDLFEAWGIEITSNLKEAICNQSEKKFFSELFELFKLMIQLRNSVTGTNIDYMVSPVENHYGTFFDSRTCDSSLPANADANGAYNIARKGLMLARRIQATPENDPISLTLSNKEWLRFAQGLDETTTYE

SEQ ID NO: 1038 - DNA, 3753 bp, synthetic construct
  misc_feature 1..3753: note = Description of Artificial Sequence: Synthetic Cas12a/Cpf1 [Barnesiella sp. An22] sequence
  source 1..3753: mol_type = other DNA
atgaaaacattatctgattttacaaatttattccctctctcaaaaacgctacggttcaaactgatacccataggtaacaccttgaagaacatcgaagccagcgggatactcgacgaagaccggcaccgggccgaaagctacgtaaaagtaaaagccatcatcgacgaataccacaaagcatttatcgaccgcgttctctccgacacctgcttgcaaaccgaaagcatagggaaacacaactcgctcgaagagttttttttctactatcaaatcggggcaaaaagcgagcaacagaagaaaactttcaaaaaaatacaggacgctctgcgcaaacagattgccgacagtctcaccaaagacaaacatttttcccgcatcgataaaaaagagttgatacaggaagaccttatccaattcgtccgggacggggaagacgctgccgagaaaacgagtctgatttctgaatttcaaaactttaccgtctactttaccgggttccacgagaaccgccaaaacatgtattcgccggacgagaaatctacggctatcgcctatcggttaatcaacgagaaccttcccaaattcgtcgacaacatgaaagtgttcgaccggattgcagccagcgaattggcctcttgtttcgacgaactgtaccacaatttcgaagaatacctgcaagtagagcggctccacgatatcttctccctcgactatttcaatctgttactcacccaaaaacatatcgacgtatataacgctttaatcggaggaaaagccaccgaaaccggcgaaaaaatcaaaggcctcaacgagtatatcaacctgtacaatcagcgacacaaacaagaaaagctgcccaaattcaagatgcttttcaagcagatattgaccgatcgcgaggccatatcgtggctcccccggcaattcgacgacaacagccaactgctctcggctatcgagcaatgctacaatcacctctcgacctataccctgaaagatgggtctctgaaatatctgctcgaaaacctgcatacctacgacaccgaaaaaatctttattcgcaacgactcgcttctgaccgaaatatcgcaacggcactatggcagctggagcatactgcccgaagccatcaagcgccacctcgaaagagccaatcctcaaaagcggcgcgaaacatacgaagcataccaaagccgcatcgaaaaagccttcaaagcttatcccggcttctcgattgcctttctgaacggttgtctgaccgaaaccggcaaagaatcgccctcgatcgaaagttatttcgagagcctgggggctgtcgagaccgaaacctcgcagcaagaaaactggtttgcccgcatagccaatgcctataccgatttccgggagatgcagaatcgcctccatgcaacagatgtccccctggcccaagatgccgaagccgtggcacgcatcaagaaactactcgatgcgctcaaagggctgcaactgtttatcaagcctctgctcgacacgggcgaagaggccgaaaaagacgaacgcttctatggcgatttcaccgaattttggaacgaactcgacaccattactcccttgtacaacatggtgcgtaactaccttacccgcaaaccctactccgaagaaaaaatcaaactcaactttcagaatcccacactgctcaacggctgggatctgaacaaggaggtcgacaacacctcggttatcctgcggcgtaacggccggtactacctggccatcatgcaccggaatcaccgtcgggtcttctcccaatacccggggacagaacgaggcgactgctatgaaaagatggagtataaactactgcccggagccaacaaaatgctgcccaaagttttcttctccaaatcgcgaatcgacgaattcaatcccagcgaagaactattggcccgttaccaacaaggcactcacaagaaaggcgagaatttcaacctgcacgactgccatgccctcatcgatttcttcaaagactcgatcgagaagcacgaggagtggcgcaatttccatttcaaattctccgacacctcctcttataccgacatgagcggcttctaccgcgaaatcgaaacacaaggttacaaactctcattcgtacccgtagcgtgcgaatacatcgacgaactggtgcgcgacggtaaaatatttctgttccagatatacaacaaagatttctcgacatacagcaaagggaagcccaacatgcacacgttgtactgggaaatgctcttcgacgaacgtaacctgatgaatgttgtctacaaactcaacgggcaagccgaaatattcttccgcaaagccagcctctcggcccggcatcccgagcacccggccggattacccatcaagaaaaaacaagcccccacagaagagagttgtttcccctacgacctaatcaaaaacaaacggtatacggtcgaccaatttcagtttcatgttcccatcacaatcaatttcaaagcaaccggcacctccaacatcaacccctcggtaaccgactatatacgcacagccgacgacctgcacatcatcgggatagaccgcggggaacggcatctgctctacctcgtggtaatcgacagccaagggcgcatttgcgaacaattctccctgaacgagattgtcactcaatatcagggacatcaatatagaaccgactatcatgccctgctgcaaaagaaagaagatgaacgacaaaaggcccgacaaagctggcaaagcatcgaaaacatcaaggagctcaaagaagggtatttgagccaggtcgttcacaaggtctcggaactgatgataaaatacaaggccatcgtggttctcgaagacttgaatgccggcttcaaacgcagccgacagaaggtagaaaaacaagtctaccaaaaatttgaaaagatgttgattgacaagctcaactatctggtattcaaaacagccgaagccgaccaaccgggcggactgcttcatgcctaccaactgaccaacaaattcgaaagtttcaaaaaaatgggaaaacaaagcggcttcctcttctatatcccggcctggaacaccagcaagatagacccgacaaccggttttgtcaatctgtttgatacccgctatgaaaacgtagacaagagccgggccttcttcggcaaattcgactcgattcgttaccgcgccgacaaagggacttttgagtggacattcgactacaacaatttccataaaaaggccgagggaactcgctcatcgtggtgcctgagctctcacgggaaccgtgtgcgaacattccggaaccccgccaaaaacaaccaatgggacaacgaagagattgacctcacccaagctttccgagaccttttcgaagcgtggggcatcgagataacctccaacttgaaagaagctatctgcaaccagtcggagaaaaagttcttctccgaactgttcgaactcttcaagctgatgattcagttgcgaaatagcgtgacaggcaccaacatcgactacatggtgtcgcccgtagaaaaccattacgggacatttttcgacagccgcacctgcgacagctccctgccggccaatgccgatgccaacggggcatacaacatcgcccgcaaagggctcatgcttgcccgacgcatacaagcgactcccgaaaacgaccccatatccctaaccctctccaacaaagaatggctgcggtttgcacaaggcttggacgaaacgacgacctatgaatga

SEQ ID NO: 1039 - DNA, 3942 bp, synthetic construct
  misc_feature 1..3942: note = Description of Artificial Sequence: Synthetic polynucleotide
  source 1..3942: mol_type = other DNA
atgggccaccatcatcatcatcatagcagcggcctggtgccgcgcggcagcggtaccatgaagactctgagtgacttcacgaacttgtttccgctcagcaagacattacgttttaaattaattccaattgggaacaccctgaaaaacattgaagcgtccggcattttggacgaggatcgccaccgcgctgaatcctacgtcaaagttaaagcaatcatcgacgagtatcataaagcatttatcgaccgggtgctctcagacacatgcttacaaacagagtccattggcaagcataattcgttagaggaattcttcttctattatcaaatcggcgcaaaaagcgaacagcagaagaagacattcaagaagatccaagacgctttgcgcaagcaaattgctgattcacttactaaagataagcacttcagccgtattgacaagaaggaattgatccaagaagatttaatccaatttgtgcgggacggggaggatgcggcggagaagacctctttaatttctgagttccaaaactttactgtctattttacagggttccatgagaaccggcagaacatgtacagtccggacgagaagtctaccgcgatcgcctaccggttgattaatgaaaacctgcctaagtttgtcgacaatatgaaagtatttgatcggattgcagcgtcggaacttgcgtcatgtttcgatgaattgtaccataacttcgaagaatatttgcaagttgaacggctccatgacatcttctccctcgattattttaatttactgctgacgcagaagcatatcgatgtatataacgctttgatcggggggaaggccaccgaaacaggtgaaaaaattaaaggcctgaacgaatatatcaatttgtataatcagcggcacaagcaggagaagttacctaaatttaagatgctttttaagcaaatcctcacggaccgggaagcaatttcctggttaccgcggcaattcgatgacaacagccaactcctttccgcaattgagcagtgttataatcacctgagtacatatactctgaaagatgggtcattgaagtatttattggaaaatttacacacgtacgatacagaaaagatcttcatccgtaacgacagcctcctgacggagattagtcagcgccattacggttcatggtcgatcttgcctgaagctattaagcggcacctggagcgtgccaacccacaaaagcggcgtgaaacctatgaagcatatcaatcgcgtattgagaaggctttcaaggcgtatcctggcttttcgatcgcttttttgaacggttgcctcacagaaacgggtaaggaaagccctagcattgaatcatattttgagtcattgggggcagtcgaaacagaaacttctcagcaagaaaactggttcgcacggattgcaaacgcatataccgacttccgtgaaatgcaaaatcgcttacatgccaccgatgtgccattggctcaggacgcggaggcagtagctcgcattaagaaactcttagacgccctgaaggggctgcaattatttatcaaacctctgttggatacaggtgaggaagcggagaaggacgaacgtttctacggggattttacagaattttggaatgaactggataccattactccgctttacaacatggtccgtaattatctcacgcggaagccttatagtgaggaaaagattaaattgaactttcagaatccgaccttacttaatggttgggacttaaacaaagaagtagataatacgagcgtcatcctgcggcgcaacggtcgctattatctggccattatgcaccgtaatcatcgtcgggttttttcacagtatccgggtacggaacgcggggattgttatgaaaaaatggagtataaactcctccctggcgctaataaaatgttgccgaaggtatttttttccaaatcccggatcgacgaatttaacccgagtgaggagctgctcgcccgctaccagcaaggcactcataagaaaggggagaactttaatttacacgactgccatgcgctcattgactttttcaaagactcaatcgaaaagcatgaggagtggcgcaacttccattttaagtttagtgacacatcttcgtacactgacatgagcgggttttaccgggagattgaaactcaaggttacaaattgtctttcgtgccagtcgcgtgcgaatatatcgatgagcttgttcgcgatggtaaaatttttttattccagatttataataaggacttctctacctatagcaagggtaagccgaatatgcacacactttactgggaaatgctcttcgacgagcgcaatcttatgaacgtagtttataaattgaacggccaagccgagattttctttcggaaagcgtcgttaagtgcccggcacccagagcatccagctgggcttccgatcaagaagaaacaggcgccgacagaggagtcttgctttccgtatgatttaatcaaaaacaagcggtataccgtagatcaatttcagttccacgttcctattactatcaactttaaagccacaggtacttctaacatcaacccgtctgtcacagactatattcgcaccgcggacgatttgcatatcattggcattgatcgtggcgagcggcatttgttatatctcgttgtgatcgatagtcaaggtcggatctgtgagcagttttcactcaatgaaattgtgacccagtatcaaggtcaccagtatcggacagattaccatgcccttcttcagaaaaaagaggacgagcgccaaaaagcgcgccagtcgtggcagagcattgaaaacatcaaagaattgaaggaaggctaccttagccaggtcgtacataaggtctcagagttaatgatcaagtataaagccatcgtggtgcttgaagatttaaacgccggttttaagcgctcccgtcaaaaggttgagaaacaagtgtaccagaaattcgaaaagatgctgatcgataaacttaattatcttgtatttaagactgcagaagcggatcagccagggggcctccttcacgcataccaattgacgaacaagttcgagtccttcaaaaagatgggcaaacagtcgggtttccttttctacatccctgcatggaatacaagtaagattgatcctacgacgggcttcgtaaatttgtttgacacacggtatgaaaatgtagataaatcccgcgcgttcttcggcaagtttgacagcattcgctatcgcgccgataaggggacatttgagtggacgtttgattacaacaacttccataagaaagcagaggggacgcgcagctcctggtgcttatcaagccacggtaatcgggtccgcacgtttcggaaccctgccaagaacaatcaatgggataacgaggaaattgatttaacccaagctttccgcgacttgttcgaggcctggggcatcgaaattacatcaaatttgaaggaggcaatctgtaaccaatccgagaaaaaattcttcagcgagctcttcgaactctttaaactcatgatccagctgcgcaatagtgtaactgggacaaacatcgactacatggtgtcaccggtagaaaaccattacgggaccttctttgactctcgcacgtgcgatagctcattaccagcaaacgccgatgccaacggggcgtataatattgcccgcaaggggctgatgctggcacgtcgtattcaagcgacgccggaaaatgatccaatctcccttactttgtctaacaaagagtggctgcgtttcgcccagggcttagacgagaccacaacatatgagggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1040 - DNA, 3942 bp, synthetic construct
  misc_feature 1..3942: note = Description of Artificial Sequence: Synthetic polynucleotide
  source 1..3942: mol_type = other DNA
atgggccaccatcatcatcatcatagcagcggcctggtgccgcgcggcagcggtaccatgaaaaccttgtcagatttcacgaacctcttcccactttcaaagaccctgcgcttcaagctcattccgattggtaatactttaaagaatattgaagcatccggtatcttagacgaggatcgtcatcgcgcagaatcatacgtgaaggttaaggcaatcattgacgaatatcacaaggctttcattgaccgcgttttaagcgatacctgcctccagactgaaagtattgggaaacataactctttagaggaattcttcttttattaccagatcggggccaagtctgaacaacagaaaaagacatttaagaagatccaagatgcccttcgtaaacaaattgctgattcgctcacgaaagataaacacttttcccgcatcgacaagaaggaacttatccaggaagacctgatccagttcgtacgggatggcgaggatgcggccgaaaaaacgagtttgatctcagagtttcagaattttacagtctatttcactggttttcacgaaaatcgccaaaacatgtactccccggacgagaagagcacggcaattgcctaccgtttgattaacgagaacttgccaaagtttgttgataacatgaaggtctttgatcgcatcgctgctagcgaactcgcctcctgctttgatgaactgtatcacaattttgaggagtatctccaggtggagcgcttacacgatatcttctctctggattatttcaatctcttgctgacacagaagcacattgacgtttataacgcacttatcggcgggaaggcaaccgagaccggggagaaaattaaaggtctcaatgagtatattaacttatacaatcaacgccacaaacaagaaaaattgcctaaattcaaaatgttgttcaaacaaattttaactgatcgggaagcaattagttggctcccgcgtcaatttgacgacaattcccaactcctttcggcaattgaacaatgctataatcatctttccacatataccttgaaagacggcagcctgaaatacttgctggaaaatttacatacctatgacactgaaaaaattttcatccgtaatgattcattgctgacagaaatctctcagcgtcattacgggtcctggtccattttaccggaagccattaaacgccaccttgaacgggcgaacccacagaaacggcgggaaacatacgaagcatatcaaagccggatcgagaaagctttcaaggcttatcctggtttcagcatcgcgtttcttaatggctgcttaaccgaaactgggaaggaatccccatcaatcgagagttactttgagagtcttggcgcggttgagacagagacttcacaacaggagaattggtttgcccgtatcgcaaatgcttataccgatttccgcgaaatgcaaaatcgcttacacgctacagatgtaccgttagcgcaagacgcggaggctgtagcgcgtattaaaaagttgctcgatgccctcaaagggttacaattatttatcaagcctcttttggacactggcgaagaagcggaaaaggatgaacgcttttatggcgatttcacggaattctggaatgaattggataccatcacacctttgtataacatggtgcgtaactaccttacacgtaaaccgtacagtgaggagaaaattaagttgaattttcagaaccctaccctgttgaatggctgggatctcaataaggaggttgataacacgagtgtgatccttcgtcgtaacggccggtattacttggcgattatgcaccgtaatcatcgtcgtgttttctctcaatacccaggcactgagcgtggggactgctatgaaaagatggaatataaactgctccctggtgccaataaaatgttgccgaaagtttttttctcaaaatcacggatcgatgagttcaaccctagcgaggagttgctcgcacgctaccaacagggtacacacaaaaaaggtgaaaactttaacttgcacgattgccatgctctgattgactttttcaaagacagcattgagaagcatgaggagtggcgtaatttccattttaagttctctgatacatcaagttacactgacatgtcgggcttctaccgggaaatcgagacccaagggtacaagcttagcttcgtccctgtagcgtgcgaatacattgatgagttggtgcgggatgggaagatctttttgttccagatctataataaggatttttcgacatactccaaagggaagcctaatatgcatacattgtattgggaaatgcttttcgatgagcgcaatttgatgaacgtggtatacaagctcaacggccaagctgagatcttctttcgcaaggcctctcttagtgcccgccaccctgagcatccagcgggcttaccgatcaaaaaaaagcaagcgcctactgaagagtcctgttttccatatgatctcattaaaaataaacgctacaccgtcgaccaattccagtttcatgtaccgatcaccattaactttaaggcaacggggacatctaacattaatccatcggtaactgactacatccggacggcagatgatctgcatattattgggattgaccgtggggagcgccacttgttatacctggttgttattgacagccagggtcgtatctgcgaacaattttcactcaacgaaattgttacccagtaccagggccaccaatatcggaccgattatcatgcgcttttgcaaaaaaaggaggacgagcgtcaaaaagcgcggcagtcctggcagagtattgaaaacatcaaggaactgaaggaagggtacttgtcgcaggtggtacataaggtaagtgaattgatgattaaatacaaggcgatcgtcgtcctggaggacttgaatgcaggtttcaagcgttcacggcaaaaagtggaaaaacaagtgtatcagaagttcgaaaagatgttgatcgacaagcttaattacttggtctttaaaacagctgaagctgatcagccgggtggtcttcttcacgcatatcagctcactaataaatttgagtctttcaaaaagatggggaagcaatcgggtttcttattttatattcctgcgtggaacacatccaaaatcgatccaaccacggggtttgtaaacttatttgacacgcggtacgaaaatgttgacaaatcgcgcgccttttttggcaagttcgattcgattcgctatcgtgcggataaaggtactttcgaatggacttttgattataataattttcataaaaaagccgaagggacgcgctcgtcctggtgtctttcctcccatggcaaccgggtacggaccttccggaacccggctaagaataatcaatgggacaacgaagaaattgacctcacgcaagcgttccgggatctgttcgaggcttgggggatcgaaattacgagcaatctcaaggaagcgatctgtaatcaatcggagaaaaaattctttagtgagttattcgagttgttcaaattaatgattcaactgcgcaattccgtgaccggcactaatattgactatatggtgtcccctgtggaaaatcattatggcacttttttcgactcccggacttgcgattcctccctccctgctaacgcagacgcgaatggggcatataatattgcacgtaaggggttgatgctggcgcggcggatccaggctactccagaaaatgatccgatctctctcaccctttcgaataaagaatggttgcgtttcgcacaagggctggatgagaccactacttacgagggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1041 - DNA, 3942 bp, synthetic construct
  misc_feature 1..3942: note = Description of Artificial Sequence: Synthetic polynucleotide
  source 1..3942: mol_type = other DNA
atgggccaccatcatcatcatcatagcagcggcctggtgccgcgcggcagcggtaccatgaaaactttatccgacttcactaacttattcccactctccaaaacgttacggtttaaacttatccctatcggtaatacgttgaagaatattgaggccagcgggatcctcgatgaagaccggcatcgcgcagaatcctatgtgaaagttaaagctattattgacgagtatcataaggcatttattgaccgtgtgctttcggacacatgcctccagactgaatcgattgggaaacataactcattggaggaatttttcttctattatcaaatcggtgcaaagtcggaacaacaaaagaagactttcaaaaaaatccaagatgctctccgtaaacaaattgctgactcgttgacgaaggataaacatttcagccgtattgataagaaagagcttattcaagaggatttgattcaattcgttcgcgacggtgaggacgctgcagagaagaccagcttgatctcggaatttcagaacttcacagtctatttcacaggttttcatgaaaaccgtcagaacatgtatagcccggacgagaagtctactgcaatcgcgtaccgtttgattaatgagaatctgcctaagttcgtagataacatgaaggtctttgatcgtatcgccgccagtgaattggctagctgctttgatgagttataccacaacttcgaggaatacttgcaagtcgagcgtttgcacgacatcttctcattggactactttaatctgctgttgacacaaaaacacatcgacgtgtataatgctctgatcggtgggaaagcgacagagactggggagaaaattaaaggtttgaacgaatacatcaatctctacaaccagcggcataaacaagaaaaactgccaaagttcaaaatgttgtttaaacagatcctcaccgaccgtgaggctattagttggcttccgcggcagtttgatgataacagtcagctccttagcgccatcgagcagtgctataaccacctttctacgtacaccttaaaggacggcagcctgaaatacctcctcgagaatttgcacacgtacgacacggaaaagattttcattcgtaatgattccttactgaccgagatttcccagcggcattacggctcatggagtattctccctgaagctattaagcgtcaccttgaacgcgctaacccacaaaaacgtcgggaaacatacgaggcttatcaaagccggattgaaaaggccttcaaagcgtatccgggtttctcgattgcttttctgaacggttgtctcacggaaacggggaaagaaagtcctagcatcgagagctatttcgaatctttgggggcggtcgagacggagacatcacagcaggaaaattggtttgctcggattgcaaacgcatacaccgatttccgcgagatgcagaaccgcttacatgctacagacgtgccgctggctcaagacgcagaggcggttgctcggatcaaaaaacttctggacgcgttgaaggggctccagttatttattaaaccgctcttagatactggtgaggaagcggagaaggatgaacgcttttatggtgatttcacggaattttggaacgagttagatacgatcactccgctctataatatggttcggaactatctgacgcggaagccgtacagcgaagaaaaaattaaattgaactttcagaatccaacattacttaatggctgggatttaaataaggaggtagataacacaagcgtcatcttacgtcgcaacggtcgttactatttggcaatcatgcaccgcaatcatcggcgggtgttctcgcagtatccagggaccgaacgtggtgactgctatgagaaaatggagtataaacttttaccaggcgccaacaagatgctgcctaaagtattcttctccaaatcccgtattgacgagttcaatccgtccgaggaactcttggcacgttaccaacaaggcactcataaaaagggcgagaactttaacctgcatgattgccatgctctcattgatttttttaaagattcgattgagaaacacgaggaatggcgtaatttccactttaagttctccgatactagcagttacaccgatatgagcggcttttaccgcgagatcgaaactcaggggtacaagcttagcttcgtcccggtcgcctgcgagtatatcgacgaacttgtccgcgacggtaaaatttttttgttccagatctacaacaaggacttttccacctatagcaaaggtaaacctaatatgcataccttatactgggagatgcttttcgacgagcggaacttgatgaacgttgtctataaacttaacgggcaggcagagatctttttccgcaaagcgagcttaagcgcccggcaccctgagcatcctgcagggttgcctattaagaagaagcaggcaccaaccgaggaaagttgctttccatatgatctgatcaagaacaagcgttatacagtagaccaattccagtttcatgtaccgatcactattaactttaaggccactgggacatcaaacatcaatccgagtgtgactgactacatccggacagcagacgacttgcacattattggtattgatcgcggtgagcgccaccttctttaccttgtagtcattgactcgcaaggtcgcatttgcgaacagttttcacttaatgagatcgtcacgcagtaccagggtcaccagtaccgcacggattaccatgcgcttcttcagaaaaaggaagacgaacggcagaaagcgcgccaatcctggcaatctattgaaaatattaaagaactcaaagaggggtatctctctcaggtggtgcataaggtctcggaattgatgatcaaatacaaggccattgtcgtgctggaggacctcaacgctggtttcaagcgttcgcgtcaaaaggttgagaagcaggtgtaccaaaaatttgaaaagatgttgatcgataagttgaattatcttgttttcaagactgccgaagctgatcaacctggggggcttctgcatgcgtatcagttgacaaataagttcgagtcctttaagaaaatgggcaaacagagtggcttcctcttctatatccctgcatggaacacgagtaaaatcgatcctaccactggcttcgttaacttatttgatacacgctacgaaaacgtcgacaagagtcgggccttctttgggaaatttgattctattcgctatcgtgcagataagggcacttttgagtggacgtttgactacaataactttcataagaaggcagaggggactcggagttcctggtgtttaagctcacatgggaaccgtgttcgtacatttcggaacccggccaagaataaccaatgggataatgaggagattgacttaactcaggcgtttcgtgatttgttcgaagcctgggggattgagatcacaagtaacctgaaggaggcaatttgtaatcagagcgaaaagaaatttttttcggaactctttgaactcttcaagttaatgattcagttgcgcaactccgtaaccggtaccaatatcgattacatggtttcaccggtagaaaatcactatgggacgttctttgatagtcggacttgcgacagtagtcttccagcgaacgccgatgccaacggcgcttacaatatcgcccggaaggggcttatgctcgcccgccgtatccaagcaactcctgagaacgatcctatctctcttacactctctaacaaggaatggcttcggttcgcacaggggttagatgagaccaccacatatgagggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1042 - DNA, 3942 bp, synthetic construct
  misc_feature 1..3942: note = Description of Artificial Sequence: Synthetic polynucleotide
  source 1..3942: mol_type = other DNA
atgggccaccatcatcatcatcatagcagcggcctggtgccgcgcggcagcggtaccatgaaaaccctttctgattttacaaatctcttcccgcttagtaagacgcttcgttttaaattaatccctattggcaatacgttgaagaacatcgaagcaagtgggatccttgatgaggaccggcatcgtgccgaaagctatgttaaggtaaaggccattatcgatgaataccacaaggcgttcatcgatcgtgtattatctgacacgtgtttacaaactgagagtattggcaaacacaacagtctggaggagttttttttttactatcaaattggggcaaagtcagaacagcaaaaaaagacttttaagaagattcaggacgccttgcgcaagcagattgctgactctctgacgaaagataaacacttttcccggattgataagaaggaacttattcaagaggatcttattcaatttgtgcgtgacggtgaggacgcggcagagaaaacgagccttatctcagaattccaaaatttcacagtgtatttcacaggcttccatgagaaccggcagaatatgtattcacctgatgaaaagtctacagccatcgcgtatcggcttatcaatgagaatcttccgaaatttgttgacaacatgaaagtattcgatcgcatcgcggctagtgaattagcaagttgctttgatgagttgtaccacaatttcgaagaatacctccaagtagagcggttacatgatatcttctcccttgattactttaatctgttacttactcaaaagcacatcgatgtctataatgcgttgatcgggggtaaagccacggaaaccggtgagaaaattaaggggctcaatgaatacattaatttgtataatcaacgccataagcaggaaaaattaccgaaatttaagatgctctttaaacaaattcttaccgatcgtgaggctatcagctggctgccgcggcagtttgatgataactcacagttactctccgctattgaacaatgctacaaccacttgtccacttacacgctgaaggatggtagtttgaaatatttattggaaaatttgcacacttatgatacagaaaagatttttattcgcaacgactcattgttaactgaaatttcgcaacgccactatggttcatggagtattttacctgaggcaatcaaacgccatttggaacgcgcgaatccgcagaaacggcgggaaacatacgaggcttatcagtctcgtattgagaaggcttttaaagcatatcctggtttttccatcgcctttttgaatgggtgcctcaccgaaacaggtaaagagagtccttccatcgaatcttatttcgagtctctcggcgctgtagaaactgagacatcacaacaagagaactggttcgcccggatcgccaatgcttatacagatttccgggagatgcaaaatcgtcttcatgccactgatgtaccgttggcccaggacgcagaagcggtagcgcgtattaaaaagttattggacgcattaaaaggtcttcagcttttcattaagccactcctggatactggtgaagaggccgagaaggatgagcggttttatggggatttcacagagttctggaacgagctggatacgattacaccattgtacaatatggttcgtaattacctcactcgcaaaccatactctgaggagaaaatcaagctcaattttcaaaacccgactttgctcaatggctgggacttaaacaaagaggtggacaatacttctgtgattctccggcgcaacggccgctactatttggcgatcatgcaccgcaaccatcgccgggtgtttagtcaatacccgggtacggaacgtggcgattgttatgagaaaatggagtataagctgttacctggcgcgaataagatgttaccaaaagtatttttttctaagtcccgcattgatgaattcaacccgtccgaggaactcttggcacggtatcaacagggtacgcacaaaaagggcgaaaatttcaatttgcatgattgtcacgccttgattgacttttttaaagactctattgaaaaacatgaggagtggcgcaactttcattttaagtttagtgatacttcgtcctatacagatatgagtgggttttatcgggaaatcgagacccaaggctataaactgtcgtttgtgcctgtggcctgcgaatacattgatgagttagtccgcgacggtaagatctttctctttcaaatctacaacaaagatttttctacatatagcaaaggtaagccaaacatgcacacactttattgggaaatgctttttgacgaacgcaatttgatgaatgtggtttataaattgaatgggcaggcggagattttctttcgcaaagcgtccctgtcagcacggcacccggagcaccctgcgggtcttccaatcaagaaaaagcaggccccgactgaagagtcatgttttccgtatgatttaattaaaaataaacgctatacggttgatcagttccagtttcatgttccaatcaccattaacttcaaagctacagggactagcaacattaatccttctgttacggattatattcgcacggcggacgatctccatatcattgggatcgaccgtggggaacgtcacctcctttacctcgttgtcattgacagtcagggtcgcatttgcgagcagttctctctcaatgagattgttactcagtaccaaggtcatcaataccggacagattaccatgcactcctccaaaagaaagaggacgagcgccagaaggcacgtcagagctggcagagcattgagaacattaaggagcttaaggagggctacttgtctcaggtagtccataaggtgagtgagttaatgattaagtataaggcaatcgttgtcttggaagatctgaacgctggcttcaagcggtctcgccagaaggtagagaaacaagtatatcagaaatttgaaaagatgctcatcgataaattgaactatctcgttttcaaaaccgccgaggctgatcagccaggcggcttgttgcacgcatatcaactcacgaataaatttgagtcgttcaaaaagatgggtaaacaaagcgggtttctgttttatatcccggcgtggaacacttcgaagatcgatccaactacaggttttgtaaatttattcgatacacgttacgaaaacgtagacaaatcacgtgctttctttggcaaattcgatagcattcgttaccgtgcggacaaaggtacattcgagtggactttcgactataataatttccacaaaaaagcagaggggacccgctccagttggtgcttatctagccatgggaaccgtgttcgtacatttcgcaatcctgcaaagaataatcagtgggataacgaagagattgatctcactcaggcatttcgcgatttatttgaggcctggggtatcgagatcacctcaaatcttaaggaagcgatttgcaatcagtcagaaaagaaatttttttcagagctgtttgagttattcaaactcatgatccaattgcggaacagcgtcacaggcacgaatattgattatatggttagcccggtggaaaatcattacggtactttcttcgatagccgtacttgtgactcctcgctccctgcaaatgctgacgctaatggcgcttataacatcgcacgtaaagggctgatgctggcacgtcggattcaggccacgcctgagaacgatccaatcagcctgacgttgtctaataaggagtggctccgttttgctcaaggtttagatgagacaactacttacgaaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1043 - DNA, 3942 bp, synthetic construct
  misc_feature 1..3942: note = Description of Artificial Sequence: Synthetic polynucleotide
  source 1..3942: mol_type = other DNA
atgggccaccatcatcatcatcatagcagcggcctggtgccgcgcggcagcggtaccatgaagacactttcggacttcaccaacttattccctctttcgaagacactccgtttcaagttgattccgattgggaataccctgaagaacattgaagcttcgggtatcctcgatgaagaccgtcatcgcgcagaatcctacgttaaagttaaggcaatcatcgacgaataccataaagctttcatcgatcgcgtgttaagcgacacatgtctgcaaaccgagagtattggcaagcataattcgctcgaggaattcttcttctactatcagattggtgcgaaaagcgagcaacaaaaaaagacttttaagaagattcaggatgctttacggaagcaaattgcggacagcctgacgaaagataaacattttagtcgtatcgataagaaggagctgattcaggaagatcttattcagttcgtccgtgacggtgaggatgcagcggaaaagacatccttaattagcgagtttcagaattttactgtatactttacaggtttccatgaaaaccggcaaaacatgtacagcccggacgaaaaatccacggccatcgcttaccgtctcattaatgaaaacctgccgaaattcgtcgacaacatgaaggtgtttgatcgcattgctgcctctgaattagcctcctgctttgatgaactttatcacaacttcgaagagtatctgcaagtagagcgcttacacgatattttttctttggactacttcaatttgctgttgacacaaaagcatatcgatgtgtacaatgcactgatcgggggtaaggcgacggagacgggtgagaagattaaagggctcaacgaatatattaacctctacaaccaacggcataagcaggagaagcttccgaagtttaagatgctctttaagcagattctgactgaccgcgaggccattagctggctcccacgccaatttgacgataactcgcaactcttatctgcaatcgagcagtgctacaaccatttaagtacatacactttgaaagacggctccctgaaatatctgttagaaaatcttcacacttacgacacagagaagattttcattcgtaatgatagtctgttaacggagattagccaacgtcactatggctcatggagtattttaccggaggctattaaacgtcatttagagcgcgctaatccgcagaaacgtcgtgagacctacgaggcataccagagccgcatcgagaaggcttttaaagcttatcctgggttttcaattgcatttctcaatgggtgcttaacggagacaggtaaagagtcgccttccatcgagtcctatttcgagtcgctcggtgcggtcgaaacagaaactagccaacaggaaaattggtttgctcgcatcgctaatgcttatactgattttcgcgagatgcagaaccggttacatgcgaccgacgtaccactggcccaggatgccgaggccgtagcacggatcaagaagctccttgatgccttaaaagggttacagctgtttattaaacctcttttggatacaggcgaggaggccgagaaggacgagcgtttctatggtgacttcaccgaattttggaacgagttagacaccatcactccgttgtacaacatggtccgtaactacttgacacgcaaaccatactctgaggaaaagattaagttgaattttcagaacccaactttgttaaatgggtgggacttgaataaggaggtcgataacacaagcgtgattctgcggcgcaatggccggtattatttagctatcatgcaccgtaatcatcgccgcgttttctcacagtatccgggtacagagcggggggactgctatgaaaagatggagtataaactgctccctggggcgaacaaaatgctgccaaaagtgttcttctcaaaaagtcgtatcgatgagtttaatccaagtgaggagcttctcgctcgctaccagcaaggcactcataaaaaaggtgagaacttcaatctccacgattgtcatgctttaatcgattttttcaaggacagtattgaaaaacatgaggaatggcgtaattttcattttaaattttcggatacctccagttacacagacatgtcgggtttctatcgtgaaattgagactcagggttacaaactgagttttgtcccggtggcatgtgaatatatcgatgaactggtacgcgatgggaagatctttctgttccagatctacaataaggatttcagcacttattcgaaggggaagcctaacatgcatacactttactgggaaatgttatttgacgaacgtaatctgatgaatgtcgtatacaaactgaacgggcaggctgagatcttttttcgcaaagcctcactttctgcacgccatccggagcacccagctggtttacctatcaaaaagaagcaggctcctactgaggaaagctgtttcccttatgacttgattaaaaacaaacgctacaccgtggatcaatttcagttccacgtgcctattacgatcaactttaaggcaacgggtacgagcaatatcaatccgagtgtgaccgactatatccgtactgcagatgacttacatatcattgggatcgaccggggtgagcgtcacctgctgtacttagtagtaattgactctcaaggtcggatttgcgaacagttttctctcaatgaaatcgttacgcaatatcagggtcaccaataccgtaccgattatcacgcgctgttacaaaaaaaggaagacgaacggcaaaaggcccggcagagctggcagtctatcgagaatatcaaggaacttaaagagggctatcttagccaggtcgtacataaagtatcagagttgatgatcaaatataaggcgatcgttgtactcgaggacctcaacgcaggtttcaaacgctcccgtcagaaagtagagaagcaagtatatcaaaagtttgaaaaaatgttaatcgataagcttaattatttggtttttaaaacggctgaagcagatcaacctgggggtttgttacatgcctatcagctcaccaacaagtttgaatcgttcaaaaaaatggggaaacagtcgggctttctcttttatatccctgcatggaatacgtcgaagatcgacccaacaacgggtttcgtgaatctcttcgatacccgctacgagaacgtcgacaagtcgcgcgcattttttggcaagttcgattcgattcggtatcgtgcggataaggggactttcgagtggacttttgactataacaacttccataagaaggctgagggtacgcgttcatcctggtgtctttccagccatgggaatcgtgtacgtacattccgcaaccctgcgaaaaataatcaatgggataacgaagaaatcgatttgacgcaagctttccgggatctgttcgaagcatggggcattgaaatcacgtcgaacttaaaagaggcgatctgcaaccagtccgagaagaagttcttctccgagttgtttgagctgttcaagctcatgatccaattacgcaatagcgttactgggacgaatatcgattatatggtatcgcctgtagaaaaccactacggcacgttctttgactcacgcacatgtgattcttcgctgcctgcgaacgcagatgccaacggtgcatacaatattgcgcggaagggccttatgttggcgcgccgtatccaagctacaccagagaatgatccaatctcccttacccttagtaataaagaatggttgcgttttgcgcagggtctggatgagacaaccacgtatgagggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1044 - DNA, 3942 bp, synthetic construct
  misc_feature 1..3942: note = Description of Artificial Sequence: Synthetic polynucleotide
  source 1..3942: mol_type = other DNA
atgggccaccatcatcatcatcatagcagcggcctggtgccgcgcggcagcggtaccatgaagacactttctgatttcactaacttattccctctctcaaaaaccttgcgttttaaacttatcccgattgggaacacgctcaaaaacattgaggctagtggtattttagatgaggaccgccatcgcgccgagagttatgtcaaagttaaggccatcatcgatgagtaccacaaggcattcattgaccgggtgctgtcagatacgtgcctccagacggaaagcatcggtaagcataactcccttgaggagttctttttttattatcaaattggggcgaaaagcgaacaacagaaaaagacgttcaaaaagatccaagacgccctccggaaacaaattgccgactcattaactaaagacaagcactttagtcggatcgacaaaaaagagcttattcaagaagatcttatccaatttgtgcgcgacggggaagacgcagccgagaaaacctcccttatttcggagttccagaacttcactgtatactttacagggttccatgaaaatcgccagaacatgtactctccagacgaaaagagtactgctatcgcgtatcggcttattaacgaaaatcttcctaagtttgttgacaacatgaaggtttttgaccgtattgctgcatctgagttagcgagttgcttcgacgagctgtatcacaacttcgaagaatatctccaggtggaacgtctgcacgacattttcagcttggattattttaatttgttattaacccagaagcacattgacgtttataatgcgctcatcggcgggaaagcaacagagaccggcgagaagattaagggcttgaacgaatacattaatctctataaccagcgccacaaacaggaaaaacttccaaagttcaagatgttattcaagcagatcctgacggatcgtgaggctatctcctggctgccacgccaatttgatgacaactcgcagttgttatccgcgatcgaacagtgctataatcatttaagtacatacactctgaaggacggctccctcaaatatcttttggaaaatcttcatacctacgacacggagaaaatttttattcgcaacgactctttgttgacggaaatttcccagcgtcattacggcagttggagtatcctgccggaagcgattaagcgccatcttgagcgggcaaatcctcagaagcggcgggaaacatacgaggcctaccagagtcgcattgaaaaggcgtttaaggcatatcctggcttttctatcgcgtttttaaatggttgcctgactgagacaggtaaagagagtccttctattgagtcctacttcgaatcattgggggctgtggagacggaaactagtcagcaggagaattggtttgcgcgcattgccaatgcctatactgattttcgggagatgcagaaccgtctgcacgccaccgatgtcccgttagcccaagatgctgaagcggtcgcacgtatcaaaaagctcttggatgccctgaaaggtctccaattatttattaagcctttgctcgatactggtgaagaagcagaaaaagatgaacgtttttatggcgattttacagaattttggaacgagctggataccattactcctttatataatatggtacggaattacttgacccgtaagccgtacagtgaggagaaaattaagctgaattttcaaaacccaacactgttaaatggctgggatctgaacaaagaagtggataacacaagtgtcatcctccgccgtaatggtcgctactatctggctatcatgcaccgtaaccatcgccgcgttttttcccaatacccggggacggagcgtggggactgttacgagaaaatggagtataagctcttgccaggcgctaataaaatgttgccaaaagtgtttttcagcaagagccgcattgatgaatttaatccgtcggaagaactgctcgcccgctatcagcagggtacccacaagaagggtgaaaattttaatttgcacgattgccacgctttgattgatttctttaaagactcgattgagaaacatgaggagtggcgcaacttccacttcaaattcagtgacacgagtagctataccgatatgtctggtttctatcgcgaaattgaaacccagggttacaaattgtcatttgttcctgtggcttgcgaatacatcgacgagttggttcgggatgggaaaatcttcttattccagatctataataaagacttctcaacttacagtaaaggtaaacctaatatgcacactctgtactgggagatgctctttgatgagcgcaatcttatgaacgtggtatacaagcttaacggtcaagctgaaatctttttccgcaaggcaagtctgagcgcgcgccatccggagcatccagccggccttcctattaaaaagaagcaggcccctactgaggagtcatgtttcccttacgacctcatcaagaataagcgctacacggtcgatcaattccagttccatgttcctattacaatcaattttaaggccactgggacctcgaatatcaatccaagcgtaacagattatatccggaccgcggacgatctgcatattatcggtatcgatcggggggagcgccatttgctgtaccttgtggtaatcgattcccaaggtcggatttgtgaacagtttagcctcaacgagattgtaacacagtatcaaggtcaccagtaccgtacagactaccatgctctccttcagaaaaaagaagatgagcgccagaaggcccgtcagtcttggcaatccatcgaaaacattaaggaactgaaagagggctatctgtctcaggtagtgcacaaagtttcggaactgatgatcaaatacaaggcgattgtagtactggaagacctcaacgcgggcttcaaacgcagccggcagaaggttgagaagcaagtttaccagaaatttgagaagatgctcattgataaacttaattacttggtgttcaagactgctgaagccgatcagcctggcggcttgctgcacgcgtatcagcttaccaacaaattcgaatcctttaaaaagatggggaaacaatcagggttcttattttatatcccggcgtggaacacgtctaagatcgacccaaccacaggttttgtcaacctgtttgatacacggtacgagaacgttgacaaatcgcgtgcctttttcggcaagttcgactcaattcgctaccgcgcagacaaagggacattcgagtggacgttcgattacaataattttcacaaaaaagctgaaggcacccgctcgagctggtgtttatcctctcacgggaaccgtgtgcgcacgttccgtaacccagctaaaaacaaccagtgggacaatgaagagatcgatttgacacaggcctttcgtgatctgtttgaagcatggggtatcgagatcacgtcgaatctcaaagaggccatttgtaatcaatccgaaaaaaagttcttcagtgaactcttcgagttgtttaagttaatgattcagctccgcaatagtgtcacaggcactaatattgattacatggtctcacctgttgagaaccactacgggacgtttttcgattctcggacatgcgactcttcactccctgctaacgccgacgccaatggtgcatataatattgcccgcaaagggttgatgttagcacgtcggattcaagcaactccagaaaacgatccgatctcccttacacttagcaacaaagagtggttgcgcttcgcgcaagggttagacgaaacaacgacctatgagggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1045 - DNA, 3942 bp, synthetic construct
  misc_feature 1..3942: note = Description of Artificial Sequence: Synthetic polynucleotide
  source 1..3942: mol_type = other DNA
atgggccaccatcatcatcatcatagcagcggcctggtgccgcgcggcagcggtaccatgaaaacactttcagactttaccaatcttttcccgctgtcaaaaacgctccggtttaagttaattccaattggcaacactctcaaaaacattgaggctagcgggattcttgatgaggatcggcatcgcgcggagagctatgttaaggtaaaagcaatcattgacgagtatcacaaggcgtttattgaccgtgtactgagtgacacgtgcttgcaaacagaaagcattggcaagcacaattctttggaggaattttttttctactatcaaatcggtgccaagagcgaacagcaaaaaaagacttttaaaaagatccaagacgcactgcgcaagcaaatcgctgactccctcacgaaagataaacactttagtcgtatcgataaaaaagagttgatccaggaagatctgattcaattcgtacgggacggtgaagatgctgcagaaaaaacgtctctcatttccgaattccagaactttactgtttacttcacggggtttcatgagaatcgtcagaacatgtattctccagatgaaaaatccaccgctatcgcttatcgtttgatcaacgagaatctcccaaaatttgttgataatatgaaggtttttgatcgtatcgctgcgagcgaacttgcctcatgcttcgacgagttataccataatttcgaggagtacttacaagtggaacgcttgcacgatatcttctcgcttgactatttcaatttattgctcacccagaaacacatcgacgtctacaatgctctcatcgggggtaaagcgaccgagactggggagaagattaaaggtttgaacgagtatatcaacctgtacaaccaacggcataaacaggagaaactcccaaaatttaagatgttattcaaacaaatcctcaccgaccgcgaagcgatttcctggcttccacgtcagttcgatgacaactcgcaactgttgtccgcaattgaacaatgttacaaccatttgtcaacgtacacgttaaaggacgggtcgcttaagtacttactggagaatttgcacacttacgatacggagaaaatcttcatccggaatgattcgcttcttactgagatttcgcagcgtcactatggttcttggtcaatcctgccggaagcaatcaaacgccatcttgagcgtgcaaatcctcagaagcgtcgcgagacttatgaggcctaccaatcacggatcgaaaaggctttcaaggcgtatcctggcttctctattgcatttttaaatgggtgtctgactgagacgggcaaggaaagcccatcgatcgagtcatactttgagtcattgggggctgtggaaactgaaacttcacagcaagaaaactggtttgcgcgcatcgcgaacgcttacaccgattttcgtgaaatgcaaaaccggctccacgcaacggatgtacctcttgcgcaagacgcggaagcagtagctcggattaagaagcttttggacgctttaaagggtctccaattgttcatcaaaccactgttggataccggggaagaagctgagaaagatgagcggttctatggtgatttcaccgagttttggaacgagcttgacacgattacgcctctctataatatggtccggaactacttaacgcgtaagccgtactcagaggagaagattaaacttaacttccagaatccaacgttattgaatgggtgggatctgaataaggaagtggataacacttccgttatcttacgccgcaatgggcggtactacctcgccattatgcatcggaatcaccgtcgtgttttttcccagtacccgggtacagagcggggtgactgctatgagaaaatggaatataaactcttaccgggggcaaataaaatgctcccaaaggtgtttttttcgaagtcccgcatcgatgagttcaatccgtcggaagaacttttggctcgctatcagcagggtacccataagaagggtgaaaattttaatctgcatgattgtcacgcattaattgacttttttaaggattccatcgaaaagcatgaagagtggcgcaactttcactttaagttctctgatacctcttcttataccgacatgtcgggcttctatcgggagattgagactcaaggttataaattatcattcgtccctgtagcatgcgaatacatcgacgagttggttcgggatgggaagatctttctctttcagatttataacaaggatttctcgacctacagtaagggcaagcctaatatgcatacactttattgggagatgttgttcgacgaacgcaatttgatgaacgtagtctataagctgaatgggcaggccgagatttttttccgtaaagcctctctgtcagcccggcacccagagcatccggctggcctcccgattaaaaaaaagcaggcgcctacagaagagagctgttttccgtacgacctcattaagaacaagcggtatacggtagatcagttccagttccatgtcccaattacaatcaacttcaaagcgactgggacatcaaatattaatccatcagtcactgactatatccggaccgctgatgatcttcacattatcggcatcgatcgcggggaacggcaccttctgtacctggtagtaatcgactctcaagggcggatctgcgaacagttcagtctcaacgagatcgtgacgcaatatcaaggccaccagtaccgcacagactaccatgctctccttcagaaaaaagaggatgagcgccagaaagcccgtcagtcttggcagtcaattgaaaatattaaggaattaaaggaaggctacctttctcaagtagtgcataaggttagtgagcttatgattaaatataaggctatcgtagtgttagaggatttgaatgcaggctttaagcgctcgcgccaaaaagttgaaaaacaggtgtatcaaaaattcgaaaaaatgcttattgataagctcaattatctggtgtttaagaccgcagaggcagatcaaccgggtgggctgctgcacgcatatcagttgactaataaattcgagtcatttaagaaaatggggaaacaatccgggtttttgttctatatcccagcatggaatacttcaaagattgacccgacaacaggctttgtcaatctctttgacacccgctacgaaaacgtagacaagtcacgcgctttcttcgggaagttcgatagtatccgctaccgcgccgacaaagggacctttgagtggacttttgactataataacttccataaaaaggcagaagggacacggagttcatggtgtttgtcttctcacggcaaccgggtacgcacgttccggaaccctgctaagaacaaccaatgggacaatgaagaaattgacctcacgcaagcgttccgcgacctctttgaagcgtggggtattgaaatcacttctaatcttaaggaagcgatttgcaaccagagtgagaagaagtttttttctgaattatttgagctttttaagctgatgattcagcttcgcaatagtgtgacaggtacaaatatcgattatatggtatcacctgtcgaaaaccactacggcacatttttcgactctcggacatgcgactcctccctcccggccaatgcggatgcgaatggcgcttacaacattgctcggaagggtctgatgcttgcccgtcggattcaagctacgccggagaatgatcctatcagtttaactctctccaacaaggaatggcttcgcttcgctcaggggctcgacgaaaccacaacatacgaaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1046 - DNA, 3942 bp, synthetic construct
  misc_feature 1..3942: note = Description of Artificial Sequence: Synthetic polynucleotide
  source 1..3942: mol_type = other DNA
atgggccaccatcatcatcatcatagcagcggcctggtgccgcgcggcagcggtaccatgaaaactctgtcagatttcacaaatcttttccctctctcgaaaacactgcgcttcaaactcatcccaattggtaacaccttaaagaacatcgaggctagtggcatcttagacgaagaccgccatcgcgcggagagttacgtaaaagtgaaggctatcatcgatgaataccataaggcgttcattgaccgggtgctgtccgatacgtgcttgcagaccgaaagcattggcaaacacaacagcttggaagagttcttcttttattatcaaatcggtgctaaatcagagcagcagaagaaaacttttaagaagatccaggacgccttgcggaagcaaattgctgactctcttaccaaagataagcattttagtcgtatcgataaaaaagaactgattcaggaggatttaatccaattcgttcgtgacggcgaggacgccgcggaaaaaacgtcattgatttccgagtttcagaattttacagtgtattttaccggtttccatgagaaccgtcagaatatgtattcccctgatgagaaatcgacagccattgcttatcggcttatcaacgaaaatctgccaaaatttgtagacaacatgaaagtgtttgatcggattgctgcgagcgagctcgcttcatgtttcgacgagttgtatcacaacttcgaggagtatttgcaagtcgaacggcttcatgacatcttttcgttagactatttcaatcttcttctcacgcagaaacatatcgatgtctacaatgctctgattggtggtaaggccacggaaaccggcgaaaaaattaaagggctcaatgagtacatcaacctttacaatcagcgccacaagcaagagaaactgcctaagtttaaaatgcttttcaagcagattcttacagatcgcgaagcgatcagctggctccctcgtcagtttgatgataattcacaattactgtcggctattgaacaatgttacaaccatctcagcacgtataccctgaaggatggctcattgaagtacttattagaaaatttgcacacgtacgatacggagaaaatcttcattcgtaacgattcattgttaacagagatttcgcagcgccactatgggtcttggtcgattttgccagaagccatcaagcgccacctcgagcgtgctaacccgcagaagcgtcgtgaaacttacgaggcataccagtcgcgtatcgagaaagcattcaaggcctaccctggtttttctatcgctttcttgaatgggtgcttaacagagacgggcaaagagtctccttccatcgaatcgtattttgagtcgttgggggctgtagaaactgaaaccagtcaacaagagaactggttcgcgcggatcgcaaatgcgtatactgactttcgtgagatgcagaaccgtttgcatgccacagatgtgccgctggcgcaggatgctgaagccgtagcacgtattaaaaaattacttgatgctttgaaagggctccaacttttcatcaaaccactgttggacaccggtgaggaggcagaaaaagacgaacgtttctatggggatttcacggaattctggaacgaactcgacaccatcactccgttatacaacatggtgcgtaattatttaacccggaagccatatagcgaagagaaaattaagctcaactttcaaaaccctacgctgttaaacggttgggatctgaacaaagaggtggacaacacttcagtgattttacgccggaacggtcgttattacttggctatcatgcaccgtaaccatcgccgcgtattctctcagtacccagggacagagcgtggggattgctacgagaaaatggagtacaagctccttccaggggccaataaaatgctccctaaagtgttcttctcgaaatcccgtattgatgagttcaatcctagcgaggagcttctcgcccgctatcagcagggcacacataagaagggtgaaaactttaaccttcacgactgccacgccttgattgatttctttaaagactctatcgagaaacacgaagaatggcgtaactttcattttaagttctccgacaccagcagttataccgatatgtctggtttttatcgcgagatcgaaacccaagggtataaactgtcctttgtacctgttgcttgcgagtatatcgatgaattagtccgggacggtaagattttcctttttcaaatttacaacaaagatttttctacatactccaagggcaagccaaacatgcacactctctattgggagatgctgttcgatgaacgtaatctcatgaatgtcgtttacaaactcaacggccaggcagagatttttttccgtaaagcctcactttccgctcgccacccggaacacccagcgggcctgccgatcaaaaaaaaacaagccccaacggaggagagttgcttcccgtacgacctgatcaagaacaaacgttatacggtggaccagttccaatttcatgtgccgattaccattaatttcaaggctaccgggacctccaacattaatccgtctgtaacggactatattcggaccgccgacgatctgcatatcattgggatcgatcggggcgaacgtcacttactttatctcgtcgttattgacagccaggggcgcatctgtgagcaattctcccttaacgaaatcgttactcagtatcagggccatcagtatcgcaccgattatcacgctctcctgcaaaaaaaagaagacgaacgtcaaaaagcacgtcagtcttggcaaagtatcgagaacattaaggagctgaaagagggctacctgagtcaagtggtacataaggtgtccgaattaatgattaaatacaaagcaattgtggtcctggaagacctgaatgccggcttcaagcgctctcgccaaaaagttgaaaaacaagtttaccaaaaattcgaaaaaatgttgattgacaagttaaattacttagtcttcaagacggctgaggctgatcagcctggtggtctccttcacgcctaccaactcacgaacaagttcgagtcctttaaaaagatgggcaagcagtcgggcttcctcttctacatccctgcttggaataccagcaagattgatccaactacaggtttcgtcaaccttttcgacacacggtatgaaaatgtagataaatcgcgtgcgttcttcgggaaattcgattcaatccgttatcgggctgacaaaggcacgttcgaatggacgttcgactacaataactttcacaaaaaagctgaggggacacgttcctcctggtgcctgagcagccatggtaaccgggtacggacttttcgtaatcctgccaaaaataatcagtgggataatgaggagatcgacttaacccaggccttccgcgatctctttgaggcctggggtattgaaatcactagcaaccttaaggaagccatctgcaaccaaagtgagaagaaattcttttctgaacttttcgaattgtttaaactcatgatccaattgcgtaacagtgttacaggtactaacattgattacatggtgtcaccagtagagaaccattacggtacattttttgactcgcggacatgtgactcatctttacctgcgaacgcggacgctaacggggcatacaacattgcccgcaaagggctgatgttagcccgccggatccaagcgactccagagaacgacccgatttcgcttaccctctctaacaaagaatggcttcggtttgcccagggtcttgacgaaactacaacttatgaaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1047 - DNA, 3942 bp, synthetic construct
  misc_feature 1..3942: note = Description of Artificial Sequence: Synthetic polynucleotide
  source 1..3942: mol_type = other DNA
atgggccaccatcatcatcatcatagcagcggcctggtgccgcgcggcagcggtaccatgaaaaccttatccgatttcaccaacttgtttccgttatctaagactctccggtttaagttaatccctattgggaacactctcaaaaatatcgaggcgtcgggtattttagatgaggaccggcaccgtgctgaaagctacgttaaagttaaggcaatcattgacgagtatcacaaggctttcattgatcgcgtcttgtcagatacctgcctgcaaaccgaatcaatcggcaagcacaacagcttggaagagttctttttttactatcaaattggtgcaaagagcgagcaacagaaaaagaccttcaaaaagattcaggatgcgttacgcaagcagatcgctgacagtctcactaaagacaaacatttcagtcgcattgataaaaaagaactgatccaagaagacttaattcagtttgtccgtgatggtgaagatgctgcagagaaaacttcacttatctccgagtttcaaaacttcacagtgtatttcaccggcttccacgagaatcgccagaatatgtactcaccggacgagaaaagtacagccattgcatatcgccttatcaacgaaaacttgcctaaatttgtcgataatatgaaggttttcgatcgcattgcagcctcggagttagcatcatgctttgatgagctttatcacaacttcgaggaatacttgcaagtcgaacgcttgcacgatatcttcagccttgattattttaaccttctcctgacccaaaagcatattgatgtctacaatgcattaatcggtgggaaagctactgagaccggcgaaaagattaaaggtttgaatgagtacattaatctttacaaccagcgccataagcaggaaaagctcccaaagtttaagatgctgttcaaacaaatcctcactgaccgcgaagcaatctcgtggctgccgcgccagttcgacgacaactcgcagctcctttcagcaatcgagcaatgctataaccatctcagtacgtataccttgaaagacgggtccttgaaatatttgttagaaaatctccatacatatgacacagagaagatctttatccgtaacgattcgttactcacggagatcagccagcgtcactacggttcctggtccattctgccggaagcaatcaaacggcacctggagcgtgccaatccgcagaaacgccgtgaaacgtacgaggcttatcagagccgtattgaaaaagcgtttaaagcctacccaggcttctctatcgcattcttgaatggttgtttgacggaaactggcaaagaatcgccttcgattgaaagttacttcgagagtctgggtgcggtggagacggagacgagtcaacaggagaactggttcgctcgtatcgcgaacgcttacaccgacttccgggagatgcaaaatcgccttcacgcaaccgacgttccactcgcgcaagatgctgaagcggttgcgcgtatcaaaaaactccttgatgccttaaaaggcttacaattatttattaagcctttactggatactggggaggaggcggaaaaggacgagcggttctatggtgattttactgaattttggaacgaactcgacacgattactccattatacaatatggtccgtaactaccttactcgcaagccttactccgaggaaaaaattaaattgaacttccagaacccaacgctgcttaatggttgggatttaaataaggaggtcgataacacttcggttatcttacggcgcaatggccgctattatctggccattatgcaccggaaccatcgccgggtgttctcgcagtatccgggcacagagcgtggcgattgttatgaaaagatggagtataaacttctcccgggtgctaataaaatgctgccgaaagtattcttcagcaagtctcgcatcgacgagtttaatccatccgaggagcttcttgctcggtaccaacaagggacgcataagaaaggcgagaatttcaacttacatgattgtcatgcattgatcgactttttcaaggactctatcgaaaaacacgaggaatggcgcaactttcatttcaaattctccgacaccagttcttataccgatatgtcggggttttaccgggagattgagacgcaagggtataaactttcgttcgtcccagtggcctgcgagtatattgacgagttggttcgcgatggcaagattttccttttccaaatctataataaggatttctcaacttatagtaaggggaagcctaacatgcatacgctctattgggagatgttattcgacgaacgtaatttaatgaacgtcgtatataaacttaacgggcaagccgagatctttttccgtaaagcgagtctttcagcccgccatccagagcaccctgcaggtttaccgattaagaagaagcaggctcctacagaggaatcgtgttttccgtatgatcttattaaaaataaacgctatacggtcgatcagtttcaatttcatgttccaattacgatcaacttcaaggccacgggtacctccaatattaatccgtccgtgacagattatattcgcaccgccgatgatctccacatcattgggattgaccgtggggagcgccacttgctctatctcgtcgttatcgattcgcagggccgtatctgcgagcagttcagcttgaacgaaatcgtaacacaatatcagggtcatcaatatcgtactgattaccacgcgctcttgcaaaagaaagaggatgagcgtcaaaaggcccgtcagtcctggcaatctatcgagaatattaaagaattgaaagaagggtacctctcgcaagtggttcataaggtttcagaactcatgattaaatacaaggctatcgtcgtccttgaggacctgaacgctggttttaagcgtagccgtcagaaggtcgaaaagcaggtgtatcaaaaattcgaaaagatgcttatcgacaaattgaattacttggtcttcaaaactgccgaggcagaccaaccagggggcctgttgcacgcgtaccaactcacgaacaagtttgaaagttttaagaagatgggcaaacaatcagggtttctcttctatatcccagcctggaatacctctaagattgacccgacgactggtttcgttaaccttttcgatacccgctacgaaaatgttgataaatcgcgcgcgttctttggtaagtttgactcgattcgctaccgggctgataaaggcactttcgaatggacctttgattacaataacttccataaaaaagcagaaggtacccgtagttcgtggtgtttgtcttctcacggtaatcgtgttcggacttttcggaacccggcaaagaacaaccagtgggataacgaagaaattgatttaacgcaagcatttcgggatctcttcgaggcatggggtattgagattacatccaatttgaaggaagctatttgtaaccaatccgagaagaaatttttctcggaactgttcgaactctttaaattgatgatccagttgcgtaattcagtaacagggaccaacatcgattacatggtatctccggtcgagaatcactatgggaccttttttgattctcgcacatgtgattccagcctgccagcgaacgctgacgcaaatggcgcttataacattgcacgcaaaggccttatgttagctcggcgtattcaagccactccagagaatgacccaatctctctgactttaagtaacaaggaatggcttcggttcgcccagggtttggatgagaccacaacgtatgaaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1048 - protein, 1300 aa, synthetic construct
  REGION 1..1300: note = Description of Artificial Sequence: Synthetic Cas12a/Cpf1 [Bacteroidetes bacterium HGW-Bacteroidetes-6 sequence
MKNMESFINLYPVSKTLRFELKPIGKTLETFSRWIEELKEKEAIELKETGNLLAQDEHRAESYKKVKKILDEYHKWFITESLQNTKLNGLDVFYHNYMLPKKEDHEKKAFASCQDNLRKQIVNAFRQETGLFNKLSGKELFKDSKEEVALLKAIVPYFDNKTLENIGVKSNEGALLLIEEFKDFTTYFGGFHENRKNMYSDEAKSTAVAFRLIHENLPRFIDNKKVFEEKIMNSELKDKFPEILKELEQILQVNEIEEMFQLDYFNDTLIQNGIDVYNHLIGGYAEEGKKKIQGLNEHINLYNQIQKEKNKRIPRLKPLYKQILSDRETASFVIEAFENDGELLESLEKSYRLLQQEVFTPEGKEGLANLLAAIAESETHKIFLKNDLGLTEISQQIYESWSLIEEAWNKQYDNKQKKVTETETYVDNRKKAFKSIKSFSIAEVEEWVKALGNEKHKGKSVATYFKSLGKTDEKVSLIEQVENNYNIIKDLLNTPYPPSKDLAQQKDDVEKIKNYLDSLKALQRFIKPLLGSGEESDKDAHFYGEFTAFWDVLDKVTPLYNKVRNYMTKKPYSTEKFKLNFENSYFLNGWAQDYETKAGLIFLKDGNYFLAINNKKLDEKEKKQLKTNYEKNPAKRIILDFQKPDNKNIPRLFIRSKGDNFAPAVEKYNLPISDVIDIYDEGKFKTEYRKINEPEYLKSLHKLIDYFKLGFSKHESYKHYSFSWKKTHEYENIAQFYHDVEVSCYQVLDENINWDSLMEYVEQNKLYLFQIYNKDFSPNSKGTPNMHTLYWKMLFNPDNLKDVVYKLNGQAEVFYRKASIKKENKIVHKANDPIDNKNELNKKKQNTFEYDIVKDKRYTVDKFQFHVPITLNFKAEGLNNLNSKVNEYIKECDDLHIIGIDRGERHLLYLSLIDMKGNIVKQFSLNEIVNEHKGNTYRTNYHNLLDKREKEREKERESWKTIETIKELKEGYISQVVHKITQLMIEYNAIVVLEDLNFGFKRGRFKVEKQVYQKFEKMLIDKLNYLVDKKKEANESGGTLKAYQLTDSYADFMKYKKKQCGFLFYVPAWNTSKIDPTTGFVNLFDTHYVNVSKAQEFFSKFKSIRYNAANNYFEFEVTDYFSFSGKAEGTKQNWIICTHGTRIINFRNPEKNSQWDNKEVVITDEFKKLFEKHGIDYKNSSDLKGQIASQSEKAFFHNEKKDTKDPDGLLQLFKLALQMRNSFIKSEEDYLVSPVMNDEGEFFDSRKAQPNQPENADANGAYNIAMKGKWVVKQIRESEDLDKLKLAISNKEWLNFAQRS

SEQ ID NO: 1049 - DNA, 3903 bp, synthetic construct
  misc_feature 1..3903: note = Description of Artificial Sequence: Synthetic Cas12a/Cpf1 [Bacteroidetes bacterium HGW-Bacteroidetes-6 sequence
  source 1..3903: mol_type = other DNA
atgaaaaacatggaatcttttatcaacctgtatccggtgtcgaaaactttgcggtttgaattgaaaccgattgggaaaacccttgaaactttttcgagatggattgaagaactgaaagaaaaagaagctattgaactaaaagaaacaggaaacctattggctcaagatgaacacagggcagaaagctataaaaaagtaaaaaaaatcctggacgaataccacaagtggtttattacagaatcgcttcagaataccaaactaaacgggttggatgtattttatcacaattacatgctcccaaagaaagaagatcatgaaaagaaggcttttgcaagttgtcaggataatctgagaaaacagatagtcaatgcattcaggcaagaaacaggtttgtttaataagctgtctggaaaagagttgtttaaggatagtaaagaagaagtcgcgcttctaaaggcaattgtgccctattttgataacaaaacccttgagaacataggagtcaaatcaaatgaaggcgccctgttactaattgaagaatttaaagacttcacaacctatttcggtggctttcacgaaaaccgaaaaaacatgtattccgatgaagccaaaagcacagctgttgcttttcgtttgatacacgaaaaccttccgcgttttattgacaataagaaggttttcgaagaaaaaattatgaattctgaattgaaagataagttcccggaaattttgaaagaacttgaacaaattcttcaagtaaatgagatagaagaaatgtttcagttggattacttcaatgatacattgattcaaaacggaattgatgtatataaccatctgattggagggtatgcagaagagggcaagaaaaaaattcagggattaaatgaacacatcaacctgtacaaccagattcagaaagaaaaaaacaaaagaatacccaggctaaagcccctttacaaacaaatattgagcgacagggaaacggcatcttttgtcattgaggcgtttgagaacgacggcgaattgttggaaagccttgaaaaaagctaccgcttactacaacaggaagtattcacccctgaagggaaagagggcttggcaaatctgcttgctgccattgctgaatctgaaacccataaaatttttctaaaaaacgatttgggacttaccgaaatatcgcaacaaatctatgagagttggtcgctaatcgaagaggcatggaacaaacagtacgacaacaaacaaaagaaggtaacggaaacggaaacttatgttgataaccgaaaaaaagctttcaaatctattaaaagtttttccattgctgaggttgaagaatgggtaaaagcattgggcaatgaaaagcataaaggcaaatcagtggccacatatttcaaaagtctgggcaaaaccgatgaaaaagtatcgttgattgaacaagtagaaaacaattacaatatcatcaaagatttgctgaatacgccttacccgccatcaaaagatttggcacagcaaaaagatgatgtggagaaaattaaaaattacctagatagcctaaaagccttgcaacggtttataaaaccacttctgggttcaggcgaagaatccgataaagatgcacatttttatggtgagtttacagctttttgggatgttctggacaaagttacaccgctttacaacaaggtaaggaattacatgaccaaaaagccctattctaccgaaaagtttaaactaaattttgaaaacagttatttccttaacggatgggcacaagattatgagactaaagcaggccttattttcttaaaagacggtaattatttcttagcaataaataataaaaaactcgatgaaaaagagaaaaaacaattaaaaacaaactacgagaagaatcctgcaaaaagaataatactggatttccaaaaacctgataataagaatattcccaggttatttattagatcaaaaggcgataactttgctcctgctgttgaaaaatacaatcttccaatatctgacgtaattgacatttacgatgaaggaaagtttaaaactgaatatcgaaaaatcaatgaaccagagtatttaaaatcgcttcataaactaattgattatttcaaattaggatttagtaaacatgaatcctataaacattatagtttttcctggaaaaagacacatgaatatgaaaatattgcacagttttatcatgatgtagaagtttcatgttatcaagtgctagatgaaaatatcaattgggattcattaatggaatacgtagagcaaaacaaactctatctcttccaaatctacaacaaagatttctccccaaacagcaagggcactccgaacatgcataccttgtactggaaaatgcttttcaatcctgataatttaaaagatgttgtttataaactcaacgggcaagccgaagtgttttaccgaaaagccagtatcaaaaaggaaaataagatcgtacataaagccaatgaccccattgacaataaaaacgaactcaacaaaaagaaacaaaacacttttgaatatgacattgttaaggacaaacgctataccgttgacaaattccagtttcatgtacccataactctcaatttcaaggctgaaggcctcaacaacctcaattcaaaagtaaatgaatacataaaagagtgtgacgatttgcacatcatcggtatcgatcgaggcgaacggcatttattgtacctgagtttgattgacatgaagggaaatatcgtgaagcaattttcattgaacgaaatcgtaaacgaacacaaaggcaatacttaccgcaccaattaccataatctgttggacaaacgggaaaaagaaagagaaaaagaaagagagagctggaaaaccatcgaaaccatcaaagaacttaaggaaggctatatttcgcaggtcgtccacaaaatcacccaactgatgattgagtacaatgccattgtagtactcgaagatttgaattttggttttaaacgcggaaggttcaaagtagaaaagcaggtatatcagaaattcgaaaagatgttgattgataaattgaactatctggttgacaaaaagaaagaggccaacgaatcaggaggtacattaaaagcgtatcaactaaccgactcttatgcagactttatgaaatataagaaaaaacagtgtggtttcttgttttacgtacctgcctggaacaccagcaagattgacccaactacaggatttgtaaacctgtttgacacccactatgtaaacgtttcaaaagcgcaggagtttttcagcaagtttaaatctatacgctacaatgcggcaaataattattttgagtttgaagtaacagattatttctcatttagcggcaaagcagaaggaacaaaacaaaactggataatttgtacacacggaacaagaattatcaatttccgaaatcccgaaaaaaacagtcaatgggataataaagaagtggtaattacagatgaattcaaaaaactatttgagaaacatggaattgattataaaaattcaagcgacttaaaaggtcaaatcgcatcacaaagtgaaaaagcattttttcacaatgaaaaaaaagacacaaaagacccggatggcctgctacaattgttcaaactagctctgcaaatgcgcaatagttttatcaaatcagaagaagattatttggtttctccggtaatgaacgatgaaggagaattcttcgacagcagaaaggcacagcccaaccaacccgaaaatgccgatgccaatggtgcatacaatattgcaatgaaaggcaaatgggtagttaaacaaataagggaaagtgaagatctggacaagctgaaactggcaatcagcaacaaagaatggttgaattttgctcaaaggagctaa

SEQ ID NO: 1050 - DNA, 4092 bp, synthetic construct
  misc_feature 1..4092: note = Description of Artificial Sequence: Synthetic polynucleotide
  source 1..4092: mol_type = other DNA
atgggccaccatcatcatcatcatagcagcggcctggtgccgcgcggcagcggtaccatgaaaaatatggaatcgtttattaacctttaccctgtttcaaagacattacggttcgagctcaagccgatcggcaaaaccttagagactttctcccggtggatcgaagagctcaaagaaaaagaggcaatcgagcttaaagaaaccgggaacttattagcacaagatgaacatcgcgcagagtcctataagaaagtgaagaaaattctcgacgagtatcataaatggtttattaccgaaagccttcagaataccaaattgaatggtttggatgttttctaccataactacatgctccctaagaaagaagatcacgagaaaaaagcctttgcctcctgccaggacaatttacgcaagcaaatcgtcaacgctttccgtcaggagactggtttgttcaacaaattgtcagggaaggaactgtttaaggactcgaaagaagaagttgcgttgttgaaagcaatcgtgccgtattttgacaataagacgcttgagaacatcggcgtgaagtccaatgagggggctctccttcttattgaggaatttaaggactttaccacatatttcggcggctttcatgaaaaccgtaagaacatgtactcggatgaagctaaatcaactgcagtagcctttcgtcttattcacgagaacctcccacggttcatcgataacaagaaagtattcgaggaaaagatcatgaacagtgagttgaaggataaatttccggaaatcctgaaggaactggaacaaatcctgcaggtgaacgagattgaagaaatgtttcagctcgactattttaatgatacacttatccaaaatggtattgacgtttacaaccatctcatcggcgggtatgctgaggagggtaagaagaaaatccagggcttgaatgagcatatcaatttatataatcagatccaaaaggagaagaataaacgtatcccgcgccttaagccgttatataagcaaattctgtctgaccgggaaacagcgtcattcgtaatcgaagctttcgagaacgatggggagttgctcgaatctctggaaaaatcgtaccgtctcttacaacaagaggtgttcacacctgaggggaaggaagggctcgcgaacttgctggccgccattgcagagtcggaaactcacaagatctttctcaagaacgacttgggcttaacagagatctcacagcagatttacgagtcctggagcttgatcgaagaagcttggaacaaacagtacgataacaagcagaaaaaagtgactgagacggagacgtatgttgacaatcgcaaaaaggcattcaaaagcatcaagagttttagtatcgctgaagttgaagaatgggtaaaagcgcttgggaatgagaagcacaaagggaaatcagttgcaacatactttaagtctttagggaagactgatgagaaggtgagcctcattgaacaagtggagaataattataacattattaaagatctcctcaacactccgtaccctccttccaaagacctcgcgcagcagaaggatgacgtagagaagatcaagaactacctcgattctctgaaggccttacagcgttttatcaaaccgctcctgggctcaggtgaggaaagtgacaaggacgctcacttctatggcgagttcaccgccttctgggacgttcttgataaggtgacgcctctgtacaataaagtacgtaactacatgactaaaaaaccgtattccacggaaaagtttaaacttaatttcgagaatagttatttcctgaacgggtgggcgcaagactatgaaacgaaggcaggtttaatcttccttaaggatggtaactacttcttagctattaacaacaaaaagctggatgaaaaggagaagaagcagttgaaaactaactatgagaagaacccagccaagcggattattcttgattttcaaaagccagataacaagaacattcctcgtttatttatccgtagcaaaggtgacaatttcgcgccagctgtagaaaagtacaatctgccaatcagtgatgtcattgacatttatgacgaagggaaatttaagaccgaataccggaagatcaacgagcctgaatatctgaaatctcttcacaaactcatcgattacttcaaattgggcttcagcaaacacgagtcatacaaacattactcattttcatggaaaaagacacacgagtatgaaaatattgcccaattctatcatgatgtagaagtgagttgttaccaagttcttgacgaaaatatcaactgggacagtttgatggagtatgtcgaacagaacaagctgtacctctttcaaatctataataaagacttctcaccaaactccaaaggcacaccaaacatgcacacgttatattggaaaatgctctttaaccctgataacctcaaggacgtcgtatataaactcaatggtcaggccgaggtgttctaccgtaaagcttcaattaaaaaagaaaacaaaatcgttcataaagcaaacgatccaatcgacaacaaaaacgagctcaacaaaaaaaaacagaacacatttgagtacgatatcgtcaaggataagcgttatactgtcgacaaatttcaatttcacgttccgatcaccttgaacttcaaagccgaaggccttaacaatctgaattctaaggttaatgagtacatcaaagaatgcgatgatctgcacatcattggcattgatcgtggtgagcgccacctgttgtatctgagtctcattgatatgaaaggtaacattgtgaaacagttcagtcttaatgaaatcgttaacgaacacaagggtaatacttaccggacgaattatcacaacctccttgacaagcgcgagaaggagcgcgaaaaagaacgcgagagctggaaaactatcgaaactatcaaggagcttaaagaaggttacatttcacaggttgtacacaaaattacgcagctcatgatcgaatacaacgcaatcgtcgtacttgaagacttaaacttcgggtttaagcgggggcggtttaaagtagaaaagcaagtgtaccaaaaattcgaaaagatgctgatcgacaaattgaattatctcgtagataaaaagaaggaagcgaatgagtctggtgggactttaaaagcttaccaactcactgattcttatgcagactttatgaaatacaaaaaaaagcagtgcggctttcttttttacgtgcctgcatggaatacatccaagattgatcctactacgggtttcgttaatctgtttgacacgcattacgttaatgtgtccaaggcccaggagttcttttcaaagttcaagtccatccggtacaacgccgcgaacaactactttgagttcgaggttacggactacttcagcttttcgggcaaagcggaaggcactaaacagaactggatcatctgtacccacgggactcggatcatcaactttcgtaacccagaaaaaaattcccagtgggacaacaaggaggtcgtaattaccgacgagttcaaaaaactttttgaaaaacacggtattgattataaaaactcgtctgatctcaaaggccaaattgccagtcagtcggagaaagcgttttttcacaatgaaaaaaaggataccaaagacccggacggcttgttacagctgtttaaactggcactccagatgcggaattcgttcatcaagagtgaggaggactacttggtttcgccagtcatgaacgatgaaggcgagttttttgactcccgcaaggcgcaaccaaaccaacctgaaaatgccgacgccaatggtgcctataacattgcgatgaaggggaagtgggtcgtgaagcagattcgggaatccgaagacttagacaagctgaaattggccatcagtaataaggagtggcttaacttcgcacaacggtctggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1051 - DNA, 4092 bp, synthetic construct
  misc_feature 1..4092: note = Description of Artificial Sequence: Synthetic polynucleotide
  source 1..4092: mol_type = other DNA
atgggccaccatcatcatcatcatagcagcggcctggtgccgcgcggcagcggtaccatgaaaaacatggagagcttcatcaacttatatccggtctccaaaacgttgcgctttgaactcaaaccaattgggaagaccttggaaaccttttcgcgctggattgaagaacttaaagaaaaagaggccatcgaattaaaagagaccgggaacttgctggcccaagacgaacatcgcgcagagtcgtacaagaaagtgaagaaaattctggacgaataccataagtggtttatcacagaatccttacagaatacgaagctgaacggtttggatgtgttctaccataattatatgttgccgaagaaagaagatcacgaaaaaaaagcattcgctagttgtcaagacaatctgcgcaaacaaattgtgaacgcgtttcggcaagaaactggtctgtttaacaagctctccggcaaggagctgtttaaggattccaaggaggaggtagcacttctgaaggcaatcgtgccatactttgataacaagacgttggaaaacattggggtaaaaagcaatgaaggtgctttgttgctgatcgaggaatttaaggatttcacgacctacttcggtggctttcatgagaaccgtaaaaacatgtatagcgacgaggctaagtccacagccgtcgcattccgtcttatccacgagaaccttccacggttcatcgacaataagaaggtatttgaggaaaaaatcatgaacagtgagctcaaggacaagtttcctgaaattctcaaggaattagaacagatcctgcaggtgaatgaaatcgaagagatgttccaattagattattttaatgataccctgatccagaatggtattgacgtttataatcatttgattggcgggtacgcggaagaaggcaagaagaaaattcaaggccttaatgaacatattaatttgtataaccagatccaaaaggagaagaataagcgcatcccacgtttgaagccactgtacaaacaaattttgtctgatcgcgaaacggcaagttttgtaatcgaagcttttgaaaatgatggggaactccttgaatcgttagaaaagtcctatcgtcttctccagcaagaagtcttcactccagaaggcaaggagggtctggcaaatttacttgcagccatcgcggagagcgaaacccataagatcttcctcaaaaacgatttggggttaacagagatcagtcaacaaatttacgaatcctggtccctgattgaggaggcgtggaacaaacagtacgataataaacaaaagaaggttacagaaacagagacatacgtggacaatcgcaaaaaggcgtttaaatcgatcaagagtttctccatcgcggaggtcgaagagtgggtgaaagctctggggaacgaaaagcataagggcaagtccgtagcgacatattttaaatcactgggcaaaaccgatgagaaggtgtcacttattgagcaagtggagaacaattataatatcatcaaggaccttttaaacaccccttacccaccttcgaaggatctggctcaacaaaaggatgacgttgagaaaatcaaaaactacctggattctttaaaagcattgcagcgttttatcaagccattattaggtagcggcgaagagtcagacaaggatgcacatttctatggggaatttaccgcattctgggacgtattggacaaagtaactccgttatataataaagttcggaattatatgacgaaaaagccgtatagcacagaaaagtttaagctgaattttgagaattcttacttccttaatgggtgggcgcaagattatgaaactaaagccggtctgatcttcttgaaggacggcaactattttttggctattaataataagaaattagacgaaaaggaaaaaaaacaattaaaaaccaactacgagaagaacccggcgaagcgtattattctcgacttccaaaagccagataataagaacattcctcgcttatttatccgttcgaaaggggataattttgctccagccgtcgaaaagtacaacttgccgatttcagatgtgatcgatatctacgatgagggcaagttcaagaccgaataccgtaaaattaacgaaccggagtacctgaagagccttcataagttgatcgactacttcaaattagggttctctaaacacgagtcctataagcactattcctttagttggaaaaaaacccacgaatatgaaaacatcgcacagttttaccacgatgtggaggttagctgttaccaagttttggacgagaacatcaactgggattccctgatggagtatgtcgagcaaaataagctgtacctcttccagatctacaataaggactttagtcctaacagtaaagggaccccaaacatgcacaccttatattggaagatgctctttaaccctgacaatttaaaggacgtcgtgtataagctgaatgggcaagccgaagttttttatcggaaggcgagtatcaaaaaggaaaataaaatcgtacacaaagctaacgaccctattgacaataaaaacgaacttaacaaaaaaaagcaaaacacttttgaatacgatatcgttaaagataaacgttatacagtggataaatttcagttccacgttccgatcacactcaacttcaaggctgagggcttgaataacctgaatagtaaggtcaatgaatacatcaaagaatgtgatgatctccatattattggcattgaccgtggtgagcggcatctgctttatttatcactgattgatatgaagggcaatattgtaaagcaatttagtcttaacgagattgtaaacgaacataaaggtaacacttaccggactaattaccataatttattggacaagcgggaaaaagaacgggagaaagaacgggagagctggaaaactatcgaaacaattaaggagctcaaagaggggtatatcagccaagttgtccacaaaatcacccagctgatgattgagtataatgcgattgtagtactggaggacctgaattttggttttaagcgcggtcgttttaaagtggagaaacaagtgtatcaaaagtttgagaagatgctcatcgacaagctcaattacctggtagataaaaagaaagaggcgaacgagtcaggtggtacgctgaaagcctaccagttgacagacagttacgcggacttcatgaagtacaaaaaaaaacagtgcggctttttattttatgttcctgcgtggaatacaagcaagatcgatccgacaacggggttcgtgaacttatttgatactcattatgtaaacgtcagtaaagcccaagaattcttttccaagtttaagtctatccgctataacgcagcaaacaattactttgaatttgaggttacggattactttagttttagcggtaaggcagaggggacaaaacaaaactggatcatttgcacacacgggacacggatcattaacttccgcaatccggaaaagaactcgcaatgggacaataaagaagtcgtaattactgacgagttcaaaaaactcttcgaaaaacacggtatcgattacaaaaattccagtgatttaaaggggcaaattgcttcgcaatcggagaaggcgttcttccataatgaaaagaaggacacgaaggacccagatgggctgttgcagctttttaaattggccctccaaatgcgcaatagttttatcaaatcagaggaagattatttagtctcaccagttatgaatgacgagggtgagtttttcgactcacgcaaggcacaaccaaatcagccggaaaacgcggacgcaaatggggcttacaatatcgctatgaagggtaaatgggttgtaaaacagatccgcgagtcggaggatttggacaaacttaaattggccatctcaaataaagagtggcttaacttcgctcaacggtctggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1052 - DNA, 4092 bp, synthetic construct
  misc_feature 1..4092: note = Description of Artificial Sequence: Synthetic polynucleotide
  source 1..4092: mol_type = other DNA
atgggccaccatcatcatcatcatagcagcggcctggtgccgcgcggcagcggtaccatgaagaatatggagtcgtttatcaacttatacccggtttcaaaaactttgcgttttgagctcaaaccaatcgggaaaaccttggaaacattttcacgttggatcgaggaattgaaggagaaggaggctatcgaattgaaagaaacgggcaatcttcttgcccaggacgaacaccgtgccgaatcctacaaaaaagtaaagaagattctcgatgaataccacaagtggtttatcacggaaagcctccaaaacacaaaacttaatggcctcgacgtattctatcacaattatatgctcccgaagaaagaggaccatgaaaagaaagcatttgcaagttgccaggataatcttcggaaacaaattgttaacgcatttcgtcaggagaccgggctttttaacaaattatcagggaaagagctctttaaggactctaaggaagaggtcgctctgttgaaagcaattgtgccatattttgataacaagacgttggagaacattggtgtcaagtctaacgaaggggcattgttgctcattgaggaattcaaagacttcactacttacttcggcggcttccacgaaaatcggaaaaatatgtattccgatgaggcgaaatctactgccgtagcattccggttgatccatgagaatctcccacgcttcattgacaataagaaagtatttgaggagaaaattatgaattcagagcttaaagataaattcccagagattctcaaagaactggagcagattttgcaagtcaatgaaatcgaggaaatgttccagctcgattatttcaacgatactctcatccaaaatgggattgatgtctacaaccatctcatcggtggctatgcggaagaagggaagaagaaaatccagggtttaaacgagcacatcaatctgtacaatcaaattcaaaaggaaaagaacaaacggattccacgcctcaagccgttatacaagcaaatcctctctgatcgtgaaaccgcttcattcgtaatcgaggcgtttgagaacgatggcgaacttctggagtccctcgaaaagtcctaccgtttgttgcaacaagaggttttcacgccagagggcaaggagggcctcgcaaaccttttggcggcgattgcagaatctgagacacacaaaatcttcttgaagaatgacttagggctgacggagatcagtcaacagatttacgaatcctggagcttaatcgaagaggcctggaacaaacaatacgacaataagcaaaagaaggtaacggaaacggagacatatgtcgataaccgtaaaaaagcattcaaaagcattaaaagcttcagcattgcagaggtcgaagaatgggtcaaggcgttaggcaacgagaaacacaagggtaaatccgttgcaacttacttcaaaagtttggggaagaccgacgagaaggtttccctcattgagcaagtggagaataattacaatatcatcaaagatctcctgaacaccccttatccgccttctaaggatctggcacaacagaaggatgatgttgagaaaattaagaattacttagatagtttgaaggccttacagcgtttcattaaacctcttcttgggtccggtgaagagagcgataaagacgctcatttctatggtgaatttacggccttttgggatgtcttagacaaagtcacaccgctgtataataaagtgcgtaactatatgactaaaaagccgtatagtacggagaagtttaagctgaacttcgagaattcttactttttgaatgggtgggcccaggattacgaaactaaagcagggctgattttcctgaaggatgggaattattttttagcgattaacaataagaagctggacgagaaggaaaagaagcagttgaagaccaactatgaaaagaacccggcgaaacggatcattttagactttcagaaaccggataataaaaacattccacgtcttttcattcgctccaaaggggacaatttcgccccggccgtagagaaatacaatcttccgatcagcgacgttatcgatatctacgacgagggtaagtttaaaactgagtaccggaagatcaacgagccggaatacctgaagagtttacataaattaattgactacttcaagcttggctttagtaagcacgagagttacaagcactattctttttcatggaaaaaaactcacgagtacgagaacattgcccaattttaccatgacgttgaagtatcatgttatcaggtactggacgagaatattaattgggacagcttaatggagtatgttgagcagaataaactttatttattccagatctataacaaagatttctcgccgaattcaaaaggtaccccgaatatgcataccttatactggaagatgctctttaatcctgacaacttaaaagatgtggtttacaagctcaacggccaggctgaagtcttctaccggaaggcttccatcaaaaaagagaataagatcgtacataaagctaacgatccaatcgacaataaaaacgaactcaacaagaaaaaacaaaatacgtttgagtatgacattgtaaaggataaacgttacactgtggacaagttccagtttcatgtacctattactttaaacttcaaggcagagggcctcaacaatttaaattcgaaggttaacgaatacatcaaggagtgtgacgatcttcatattatcgggattgatcgtggtgaacggcacttactgtatttgtcactcattgatatgaaaggcaacatcgtcaaacagttctcgctcaacgaaatcgtaaatgagcataagggtaatacatatcggactaactatcataatttacttgataaacgggaaaaggaacgcgaaaaagaacgcgagagctggaaaactatcgaaaccatcaaggagctcaaagagggctatatttcacaggtcgtacataaaatcactcagttgatgatcgagtacaacgcgatcgttgtgttggaggatttaaattttgggtttaaacgtggtcgttttaaggtcgaaaagcaagtgtatcaaaagttcgaaaagatgctgattgacaaattaaattatctggtggacaagaagaaagaggcaaatgaatcaggtgggacattgaaggcataccaactcacggattcttatgctgacttcatgaagtataagaaaaagcagtgcgggtttttattctatgttccagcctggaacacttcaaagatcgatccgacgacaggctttgtaaacctcttcgatacgcactacgtgaatgtcagcaaggcacaagagtttttcagcaaattcaagtcgattcgctacaacgcggcaaacaattattttgaatttgaagttactgactatttttcattttcagggaaggcggaaggtacgaaacaaaactggattatttgcacccacggcactcggattattaattttcggaacccggaaaaaaactcacagtgggacaacaaagaggtcgtaatcactgatgagttcaagaaactctttgagaaacacgggattgactacaagaacagttctgatttgaagggccagatcgcatcacagtctgaaaaggcgttttttcataatgagaaaaaggacacaaaggatccggacggcctcttacagctctttaaactggccttgcaaatgcgcaactcatttattaagtcagaggaggattatttggtttcaccagtcatgaacgacgaaggggagttcttcgattcgcggaaggcccagccgaaccaaccggaaaatgctgatgcaaatggtgcctataacattgcgatgaaggggaagtgggtcgtcaaacagatccgcgaatcagaagacttggataagttgaaactcgccatctcgaacaaggagtggcttaacttcgcgcagcgtagtggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1053 - DNA, 4092 bp, synthetic construct
  misc_feature 1..4092: note = Description of Artificial Sequence: Synthetic polynucleotide
  source 1..4092: mol_type = other DNA
atgggccaccatcatcatcatcatagcagcggcctggtgccgcgcggcagcggtaccatgaagaatatggagagcttcattaacttgtaccctgtatctaagacgttgcgttttgagcttaagccgattggcaagacgctggagaccttctcccggtggattgaggagttgaaagaaaaagaagcgatcgaattgaaggagacaggcaatcttttagcgcaagatgagcaccgcgctgagtcctataagaaggtaaagaaaattctggacgaatatcacaaatggttcattaccgaaagccttcagaacactaagttgaacgggcttgacgtcttttatcacaactacatgctgccgaaaaaagaagaccatgaaaagaaggcgtttgcatcgtgtcaggacaacttacggaaacaaatcgtgaatgcctttcgccaggagacaggcttatttaataagctctccggtaaggaactgtttaaagactcaaaagaggaagtcgcattgttgaaagccattgtcccgtacttcgataataaaactctggagaatattggggtcaagagcaacgagggtgctcttctgttaatcgaagagttcaaagatttcaccacttactttggtgggtttcacgaaaatcggaaaaatatgtattcagacgaggcgaaatcgacggccgtcgcctttcgtctgatccatgaaaatttgccacggttcattgacaataagaaggtttttgaggaaaagatcatgaatagcgaattaaaagacaaattcccggaaatccttaaagagctcgagcaaatccttcaagtgaacgagatcgaagaaatgttccagctcgactacttcaatgatacactgatccagaatggcattgacgtatacaatcacctgatcggtgggtatgcagaagaaggtaaaaaaaaaatccagggtttaaatgagcatattaatctttacaaccaaatccaaaaggaaaagaacaaacggatcccacgcttaaagccgttgtacaagcaaattctctctgatcgcgagactgcaagcttcgtaatcgaagctttcgagaacgacggtgaacttctcgaatcgctggaaaaatcatatcggcttctccagcaggaggtgtttacgccagagggtaaagagggtcttgcgaatttgcttgctgccattgcggaatccgagacgcataaaatttttctcaaaaatgacttgggccttacggaaatctcgcaacaaatctacgaaagctggtcacttatcgaggaggcctggaacaaacaatacgacaataaacagaaaaaggtaacggagactgagacctatgttgataatcggaaaaaagcttttaaatcaattaaatctttctctatcgcggaggtggaagaatgggttaaagcgttgggtaacgagaaacacaaagggaagagtgtggcgacatatttcaagagtctcggcaagacggacgagaaagtttctctgatcgagcaagtagagaacaactataatattatcaaggatttgttgaacacgccatacccgccgagtaaggaccttgcccagcaaaaggacgatgtggagaaaattaagaattacttggattcgctgaaggcactccaacggttcattaaaccacttttaggttcaggtgaagagagcgacaaggacgcacatttctacggcgagtttacggcattctgggacgtcttggacaaagtgaccccattatacaacaaagtccgtaattacatgacaaaaaagccatattcgacggaaaagtttaagctgaacttcgaaaactcttacttcctcaacggctgggctcaggattatgaaaccaaagctggcctgatcttcctcaaagacggcaattacttcctggcgattaataataagaaactcgatgagaaagagaagaagcagctcaaaacgaactatgaaaagaatccagctaagcgcatcattcttgactttcaaaaacctgacaacaagaatattcctcgtctgtttatccgctccaagggtgacaatttcgccccagcagttgagaagtataatcttccaattagcgatgtcattgacatctatgatgagggcaaattcaaaacagagtaccggaaaattaatgagcctgagtacttaaagtctctccacaagcttatcgattattttaagctgggcttttcgaagcatgagtcctataagcattactcattttcctggaagaaaacgcatgagtacgagaatattgcacagttttatcacgatgtggaggtgtcttgttatcaagttttagatgagaacatcaactgggactctcttatggagtatgtggagcagaataagctgtatttgttccaaatttataacaaggacttctctccgaactccaaggggacccctaacatgcataccctttactggaaaatgctgtttaaccctgataacctgaaggatgtcgtctataagctgaacggccaagctgaggttttttatcgcaaggcgtctatcaagaaggaaaataaaattgtgcacaaggctaacgatccgatcgacaacaaaaatgagcttaacaagaagaagcaaaacacttttgaatacgatatcgttaaagataagcggtacaccgtggacaaattccagtttcacgtccctattaccctgaatttcaaggctgaggggttaaataacttaaacagtaaagtaaatgaatacattaaggaatgtgatgacctgcatatcatcgggattgaccggggggagcggcacctgctctatttaagcttgattgatatgaagggcaacattgtgaaacaattctcgctgaatgaaattgtcaacgaacataaggggaacacttatcgtacgaattatcataacctccttgacaaacgggaaaaagaacgcgaaaaggagcgtgaatcttggaaaactatcgagactattaaggagttaaaggaggggtacatttcgcaagtggtacataaaattacacagctgatgattgagtacaacgctattgtcgttttagaggatttgaattttggctttaaacggggtcgctttaaggtagaaaagcaagtctaccagaagttcgaaaagatgttgattgataagctcaattatttggtggataagaagaaggaggctaatgaaagcggggggacgcttaaagcctatcagcttacagattcctatgcggactttatgaagtacaaaaaaaaacagtgtggttttctcttttatgtacctgcttggaacacgtccaaaattgatcctacaactggctttgtgaatctgttcgatactcactatgttaacgtgtccaaggcccaggagttcttctcaaagttcaaaagcatccggtacaacgcagcaaataactattttgagttcgaagtgaccgattatttttcattttcaggtaaggcggagggcactaaacaaaactggattatctgcacgcacggtactcgcatcattaatttccggaacccagaaaaaaactcccagtgggacaacaaagaagtggtcattacggacgaattcaagaagttattcgagaagcatgggatcgattataaaaactcaagcgacctgaagggccagattgcctcacagtcagagaaagctttcttccacaacgaaaaaaaggataccaaggatccagacggcctcttacaactttttaaactggctctgcaaatgcggaacagtttcattaagtcagaggaagactatttggtctccccggtaatgaatgatgagggtgagttttttgactcccgcaaagctcaacctaatcagcctgagaacgcagatgcgaacggcgcttataatatcgcgatgaaaggcaaatgggttgtcaaacaaattcgtgagagcgaagacttagacaagcttaagttggctattagtaataaagaatggttgaatttcgcacaacgttccggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1054 - DNA, 4092 bp, synthetic construct
  misc_feature 1..4092: note = Description of Artificial Sequence: Synthetic polynucleotide
  source 1..4092: mol_type = other DNA
atgggccaccatcatcatcatcatagcagcggcctggtgccgcgcggcagcggtaccatgaaaaacatggagtcgttcattaacctgtacccagtcagtaagacattgcggtttgagcttaagccgattggtaagactctcgagacattctcccgctggatcgaggaattgaaagaaaaagaggcgatcgagcttaaggaaacgggcaatcttctggcccaagatgaacatcgggcggagtcctataagaaagtcaaaaaaatccttgacgagtatcacaaatggtttattacggagtccttacagaacactaagctcaacgggttagacgtgttctatcacaactatatgctcccgaagaaagaagatcatgaaaagaaagcctttgcatcgtgtcaggataatttacggaaacagatcgttaacgcctttcgtcaggagaccggtctctttaataaactctcgggtaaggaattatttaaggactcgaaggaagaagttgctttattgaaggcgattgttccatacttcgataacaagactctggagaacattggggtcaaatcgaacgagggtgctcttttacttattgaggagtttaaggatttcacgacatatttcgggggttttcacgagaatcgtaagaatatgtattctgatgaagcgaagtcaactgcggttgcattccgtttgattcatgagaatctcccacgtttcattgataacaaaaaggtcttcgaagaaaaaatcatgaattcagaacttaaggataagttcccagagattctgaaggaactcgaacaaattcttcaggtgaacgaaattgaggagatgtttcaacttgactatttcaatgatacccttatccagaatgggatcgatgtttacaaccatttaattggtgggtatgcagaggagggtaagaaaaaaatccagggtcttaacgagcatattaatctgtacaatcaaattcaaaaagaaaaaaacaaacgcatcccacgcctgaaacctctctacaaacaaatcctctctgatcgggaaaccgcctctttcgttatcgaagcctttgagaacgacggtgagttgctcgagagcttggagaaatcctaccggttgttgcaacaggaagtatttactccagaaggcaaggaaggtctcgctaatctcctggcagctatcgccgagagtgagacacacaaaatttttttaaagaacgatctggggctgacggaaattagtcagcagatctatgagtcgtggagtcttattgaggaagcttggaacaaacaatatgataacaaacaaaaaaaggtaactgaaacagagacatatgtcgataaccgcaaaaaggcttttaaatcgatcaaatctttctcaatcgctgaagtcgaagaatgggttaaggctttgggcaacgaaaaacacaaggggaaatcagtagccacgtactttaagagcttaggtaagaccgacgagaaggtctcgttaattgagcaggttgagaacaattacaacattattaaagacttgttaaatacaccgtacccaccaagtaaagacctcgctcagcaaaaggatgacgttgagaagatcaaaaactacctggactcacttaaggcacttcagcggtttatcaaacctcttctggggtcgggggaggaatctgacaaagacgcgcatttctacggcgagttcacggcattttgggacgttttagacaaggtaacgcctctttacaataaagtacgcaattacatgacgaaaaagccgtatagcacagaaaaatttaaactgaactttgagaactcatatttccttaatgggtgggcgcaagattacgagacaaaggccggcctgatcttcctgaaagacggtaattactttttagctattaacaataaaaagctcgacgaaaaggagaagaagcagcttaaaaccaattatgaaaaaaaccctgctaagcgtatcattttggactttcagaagccagacaacaagaatatccctcgcctctttatccgcagcaaaggcgataattttgcgccagctgtggaaaagtataatcttccgatttccgacgtgatcgacatttatgatgaaggcaagtttaaaactgaatatcggaagattaacgaacctgaatatcttaagtcgttacataagctcatcgactatttcaagttaggtttttcgaagcatgagagttacaaacactattcctttagttggaagaagacccacgaatatgagaatatcgctcaattctatcatgatgtggaggtctcttgctaccaagtactcgatgagaacatcaattgggactccttaatggagtatgtagaacagaataagctgtatctctttcagatttacaacaaggacttttccccgaactcgaagggtacaccaaatatgcacacactgtattggaagatgctgtttaacccggataatctcaaagatgttgtctacaaactcaacggccaagctgaagttttttatcgtaaagcttcaattaaaaaggagaataaaattgtgcacaaagcgaacgatcctattgacaacaagaatgagttgaacaaaaagaagcagaacactttcgagtacgatattgttaaagataagcgttatactgttgacaagtttcagttccatgttccgattactttaaattttaaggctgaagggctgaacaatttaaatagcaaggtaaatgaatacatcaaagaatgtgacgatttacacatcatcgggatcgatcgtggtgaacgccatttgctttatttgtcattgatcgatatgaaggggaacattgttaaacaattttcgttgaacgagatcgtgaacgaacataaagggaacacataccggacgaactaccataatttattggataagcgcgaaaaggagcgcgaaaaagagcgtgaaagctggaaaacgatcgagacgattaaggaactcaaggaggggtatatttctcaagtagtccacaaaattacacaattgatgattgaatacaatgccattgtcgtccttgaggatttgaactttggctttaagcgcggtcgtttcaaggtcgagaagcaagtgtaccagaagtttgagaaaatgttgattgataagttaaattatttggtggataaaaaaaaagaagccaacgaatccggcgggactctgaaagcatatcaactgacagacagctacgcagactttatgaaatataaaaagaaacaatgcgggtttctcttctatgtcccggcctggaacactagtaagattgacccaactactggtttcgtaaaccttttcgatacccactatgtcaatgtgagcaaggcgcaggaatttttctctaaattcaaatctattcggtacaatgcagccaacaattatttcgaattcgaggttacagattacttctcattcagtggtaaggccgagggtacaaaacaaaactggatcatctgcacacacgggacacggattattaacttccgtaacccagagaagaattctcaatgggacaacaaagaggtggtgattaccgacgaatttaaaaagttattcgaaaagcatggtatcgactacaaaaacagtagcgacttaaaaggccagattgccagtcagagcgaaaaagcatttttccacaatgaaaaaaaggacacaaaggatcctgatgggctcctccaactgttcaaactggcccttcagatgcggaattcctttattaagagcgaagaagattatcttgtttcgccggtcatgaacgacgagggtgaatttttcgactcgcgcaaggcccaaccgaaccaaccggaaaatgcggacgccaacggcgcatacaacattgcaatgaagggtaaatgggtcgtgaaacaaatccgggaatctgaagacttagataagctgaagctggccatctcaaataaggaatggctcaactttgcccagcggtcaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1055 - DNA, 4092 bp, synthetic construct
  misc_feature 1..4092: note = Description of Artificial Sequence: Synthetic polynucleotide
  source 1..4092: mol_type = other DNA
atgggccaccatcatcatcatcatagcagcggcctggtgccgcgcggcagcggtaccatgaaaaacatggagagtttcattaatctgtatccagtgtcaaaaactttgcggttcgagttgaagccgatcggcaagaccttggagacattttctcgctggatcgaggaacttaaagaaaaagaggctatcgaattaaaggagacgggtaatttgcttgcgcaggatgaacaccgggcggaaagttacaaaaaggtaaaaaaaattctcgacgaatatcataaatggtttatcactgagtcattacaaaacacaaaattaaatggtttggacgttttctatcataattatatgcttccgaaaaaggaagaccacgagaaaaaggcgtttgcctcgtgccaggataatttgcgcaagcaaattgtaaatgctttccgtcaagagaccgggttgttcaacaaactgtcggggaaagagctgtttaaggattcgaaagaggaagttgcgctgctcaaggctattgtaccatacttcgataacaaaaccctcgaaaacatcggcgtcaaatcaaatgaaggcgcattactcctcatcgaggaatttaaagactttaccacctacttcggtgggttccatgaaaatcggaagaatatgtattctgatgaagcgaaatcaactgctgttgcatttcggctcatccacgaaaatttaccacggttcatcgacaataagaaagtctttgaggagaagatcatgaacagcgagctcaaggataaattcccagagatcttgaaggaattagaacaaatcttgcaggttaatgagatcgaagagatgtttcagctggactacttcaatgatactctgatccagaatggtattgatgtatacaaccaccttattggggggtacgccgaagaaggcaaaaaaaaaattcaagggttgaatgagcacatcaacctgtacaatcagatccagaaggaaaaaaataagcgtattccacgcctcaaacctctctacaagcaaatcctctctgatcgtgagacagcctcattcgtgatcgaggcgttcgagaatgatggcgaacttctggaatccctggagaaatcttaccgcttgctgcagcaggaagttttcacgcctgaaggtaaggaagggttggcgaacctgctggctgcaattgccgagagcgagacgcacaagatctttttgaagaacgacctggggcttacagaaatttcccaacaaatctatgagagttggtcactgattgaagaggcctggaacaaacagtacgataacaaacaaaaaaaagttacggaaacggaaacttatgtggacaaccgtaagaaggctttcaagtcgattaagtccttctccattgccgaagttgaggaatgggtgaaagctctcgggaacgagaaacataaaggtaaaagtgtggcaacgtacttcaaatcgctgggtaaaaccgatgaaaaggtaagccttattgagcaagtagagaataactacaatattatcaaggatctcttaaatacgccataccctccatccaaggatcttgcccagcaaaaggatgatgtagaaaaaattaaaaattatttggattccctgaaggcgttgcagcgtttcatcaagcctcttcttggctcgggtgaagagagcgataaagatgcccacttctatggggagtttaccgcgttctgggacgttttagataaagtcactcctttgtacaacaaggtgcggaactatatgaccaagaaaccgtactctactgagaaatttaaactcaatttcgagaactcctatttccttaatgggtgggcacaggattatgagaccaaggcggggctcattttcttaaaggatggcaactactttctggccattaataacaaaaaactcgacgagaaagaaaagaaacagctcaagactaattatgagaagaacccagcgaaacggattattttagattttcagaagcctgacaacaaaaatatcccacgtctgttcatccgttctaagggcgacaattttgccccagccgttgagaagtataacttacctatttcagacgtgattgacatttacgatgagggtaaattcaaaactgaataccgtaaaatcaatgaaccggagtacttaaaaagtctgcataagttgattgactattttaagttaggtttcagtaaacacgagtcatacaagcactacagcttctcttggaagaaaacacacgagtacgagaacatcgcacagttctatcatgacgttgaggtcagttgctaccaagtactcgacgagaacatcaattgggatagtttgatggagtatgtggaacaaaacaagctttatctcttccaaatctacaataaggattttagcccaaatagcaagggcaccccgaacatgcataccttatactggaaaatgttatttaatccagacaatcttaaagatgttgtctacaaattgaacgggcaagccgaggtcttctaccgcaaagcttcgatcaagaaagaaaacaaaatcgttcacaaagcaaacgacccgatcgacaacaagaatgaattaaacaagaaaaagcagaacactttcgagtatgatatcgttaaagataagcggtatacggtggacaagtttcagttccacgtccctatcaccttgaactttaaggcggaagggctcaataacctgaacagcaaagtcaatgaatacattaaagagtgcgatgatcttcatattattggcatcgatcgtggggagcggcatttgctctatctgtcgctgattgatatgaaaggtaatattgtcaaacaattctccttgaatgagattgtaaacgagcataagggtaacacgtaccgtactaattaccacaatctgcttgacaaacgggaaaaggagcgggagaaggaacgcgaatcgtggaagacaattgagactattaaggagttaaaggagggttatatcagtcaagtagttcataagatcacacaactgatgattgaatataatgccatcgttgttttggaagatctcaacttcgggttcaaacgtggccgttttaaagttgagaagcaggtataccagaaattcgaaaaaatgttgattgacaagttgaactatcttgtagacaaaaaaaaagaggccaacgagagtggtggtactcttaaggcttatcagctcactgattcatatgctgacttcatgaagtataagaaaaaacagtgtgggttcctgttctacgtgccggcatggaatactagtaaaattgatcctacgaccggctttgtaaacctgtttgacacacattacgttaatgtgtcgaaagctcaggagttcttctcgaagttcaaaagcattcgctataatgcggccaacaattatttcgagttcgaggtcactgactatttctctttttccggcaaagcggaaggtactaaacaaaactggatcatttgtacccatggtactcgcattatcaacttccgcaatccggaaaaaaactcccagtgggacaataaagaggtcgtaatcactgacgagttcaaaaaactttttgaaaagcatggtattgactataagaatagtagcgacctgaaaggccagatcgcatcgcagagtgagaaagcattcttccacaatgaaaagaaagatactaaagatcctgatggtcttctccagttatttaagttagcgctccagatgcgtaattcctttatcaagagtgaggaggactacttggtgtctccggtaatgaatgatgaaggtgagtttttcgattcccggaaagcccagccaaatcagccagagaacgcagatgctaatggggcgtacaacattgccatgaaggggaagtgggtagtcaaacagatccgggagtctgaggatcttgataagctgaaattggcaatctcgaataaggaatggttgaattttgctcagcgctctggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1056 - DNA, 4092 bp, synthetic construct
  misc_feature 1..4092: note = Description of Artificial Sequence: Synthetic polynucleotide
  source 1..4092: mol_type = other DNA
atgggccaccatcatcatcatcatagcagcggcctggtgccgcgcggcagcggtaccatgaagaatatggagtcctttatcaatctgtaccctgtgtcgaaaacacttcgtttcgaattgaaaccaatcgggaagaccctggaaacgttcagtcgttggattgaagaactcaaagaaaaggaagcaattgaactgaaggaaacagggaaccttttagcacaggatgagcatcgcgccgagtcgtacaagaaagttaaaaaaattcttgacgaataccacaagtggttcatcactgagtctctccagaatacgaaacttaacggtcttgacgtattttaccacaattatatgttgcctaagaaggaagaccatgagaaaaaagcgttcgcctcctgtcaggacaacttgcgtaaacagatcgtgaacgcctttcggcaagagacaggtctcttcaacaagctcagcggtaaagaactcttcaaggactccaaagaggaggtagctctccttaaagcaattgtgccttacttcgacaataagacgttggagaatatcggcgtaaagtccaacgaaggcgcattgcttttgattgaagagttcaaggactttacgacttatttcggggggtttcacgagaaccggaaaaacatgtactccgacgaagcgaaatcgacagctgtggcttttcgtctcatccacgaaaacttaccgcgctttattgataataagaaagtattcgaggagaagattatgaattcggagcttaaggacaagttccctgaaatcttgaaagagcttgagcagatcctgcaggtaaatgaaattgaggaaatgtttcagttggattatttcaacgatactcttatccagaacggcatcgacgtttacaaccatctcatcgggggctacgctgaagagggcaagaagaagattcaaggtttaaacgagcacattaacttgtataaccaaatccagaaagaaaagaataaacggatcccgcgtttgaaaccattgtacaagcagatcttgtctgaccgggagaccgcgtcttttgttatcgaggcatttgaaaacgatggggagctcctcgaaagcttggagaaatcgtatcgcttattacaacaggaggtttttaccccagaaggcaaagaaggtttagcgaaccttctggcagcaatcgctgagagtgaaacccacaaaattttcctgaagaacgaccttgggttgaccgagatttcacagcaaatctatgaatcctggtcgctgattgaagaggcctggaataagcaatacgataacaagcagaaaaaggtaacagagactgaaacctacgttgataaccggaaaaaagccttcaaaagcattaagtctttctcaattgcggaggtagaggagtgggtcaaagctttagggaatgaaaaacacaaggggaaatccgttgcaacatatttcaaatcacttggtaaaacggacgaaaaggtctctctgattgagcaggtcgagaataactacaacatcattaaagatttgctgaataccccatatccgccgtcgaaagacctcgcccagcagaaggacgacgtagagaagatcaaaaattatctcgatagcttaaaagcactccaacgtttcattaagcctttgttgggttccggcgaagaatcagataaagacgcgcacttttatggtgaattcactgctttctgggacgtgcttgataaggtgacccctttgtataataaggttcgtaattatatgaccaagaaaccgtattctacggaaaaatttaagttgaatttcgagaacagttattttcttaacggttgggcacaagactatgagaccaaagcgggtcttatcttcctgaaggacggtaactacttcttagctattaacaacaaaaaacttgacgaaaaggaaaagaaacagttaaagacgaattatgaaaaaaatccagccaaacgcatcattcttgacttccagaaaccggacaacaagaacattccacgcttgttcatccgttcgaaaggtgataactttgccccggcagttgagaagtataacctgcctatcagcgatgtcatcgacatttacgacgagggtaagttcaagacagaataccggaaaattaatgagccggagtatctgaagtcccttcacaagttgatcgactactttaagctgggtttctccaagcatgagtcttacaaacactattctttttcgtggaagaagactcatgagtatgagaatatcgcgcagttctatcacgacgttgaggttagttgctaccaggttctcgatgaaaacatcaactgggattctctcatggaatatgtagaacagaacaagttatatttatttcagatttacaacaaagacttttcccctaactctaaaggcaccccaaatatgcatacgctttactggaaaatgctttttaacccagataacctgaaagacgtcgtgtacaaactgaacggtcaggctgaggtgttctaccggaaagcatctattaaaaaggagaacaagatcgtccacaaggcgaacgatccgatcgataataagaatgagcttaataaaaagaagcaaaacacctttgagtacgacatcgtaaaagacaagcgctacacggtggacaaattccagtttcatgtcccaattactttgaatttcaaggcggaggggcttaacaatctcaattccaaagtcaacgaatacatcaaagagtgtgacgacttgcacatcatcggcattgatcggggcgaacgccatcttttgtatctttcattgattgatatgaaaggtaatatcgttaaacaattctcactcaacgaaattgttaatgaacataagggtaatacatatcgtaccaattatcacaaccttttagacaaacgcgaaaaggaacgtgagaaggaacgcgagagctggaaaaccattgaaactatcaaggagttaaaagaaggctacatttctcaggtggtacacaaaattacgcagctgatgattgagtacaacgccatcgtggtgctggaggatctcaactttggcttcaagcggggccggttcaaagtggaaaaacaggtttatcaaaaatttgagaaaatgttaatcgataagctgaactatctggtagataagaagaaagaggccaacgaaagtggcggtacacttaaggcctatcagttgacagattcatacgcggattttatgaagtacaaaaagaaacagtgcggtttcttattctacgtacctgcgtggaacacatcaaagatcgatcctacgacaggtttcgtaaacctttttgatacccactacgtaaatgtctctaaagcccaggaattcttctctaaatttaaatcaatccgctacaatgccgcaaacaactattttgagttcgaggtaaccgattacttctccttttcaggcaaagcagaaggcacaaagcagaattggattatttgcacacatgggacacgtattatcaatttccgtaatcctgagaaaaacagtcaatgggataataaggaggtggtaatcaccgacgaatttaagaaattgtttgagaaacatggtatcgattataaaaacagttctgatttaaaagggcagattgcctctcagtcggaaaaggctttcttccataacgagaagaaggacaccaaggatccggatgggctgctgcaactttttaagttagcattgcagatgcggaatagttttattaagagtgaagaagactaccttgtatcgccggtcatgaatgacgagggggagttttttgattcgcgcaaagcccagccaaaccagcctgaaaatgccgatgctaacggggcttataacattgcgatgaaggggaagtgggttgttaaacagatccgggaaagcgaagacttggacaagttgaaattagctatttccaataaagaatggcttaacttcgcccagcgcagcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1057 - DNA, 4092 bp, synthetic construct
  misc_feature 1..4092: note = Description of Artificial Sequence: Synthetic polynucleotide
  source 1..4092: mol_type = other DNA
atgggccaccatcatcatcatcatagcagcggcctggtgccgcgcggcagcggtaccatgaaaaacatggagagcttcatcaacttgtacccggtttcaaaaacacttcgttttgaattgaaacctatcgggaaaacattggaaaccttctctcggtggattgaggaacttaaagaaaaagaggcgatcgaactgaaggagacagggaatctcctcgcgcaagacgagcaccgggcagaatcgtataaaaaggtaaagaaaatccttgacgaatatcacaaatggtttatcactgagtcgttacaaaacacaaagcttaacggccttgatgttttctatcataactatatgttgccaaagaaggaagaccacgaaaaaaaggcttttgcctcctgtcaggataacctccgtaagcaaatcgtcaacgcattccgtcaggagactggtttgttcaacaaactttccggtaaggagctctttaaagacagcaaggaagaggtcgcgcttttgaaagcgattgttccttactttgacaataaaacgttggaaaacatcggcgtcaaatctaatgagggtgctttacttctcatcgaagagttcaaagacttcaccacctactttggggggtttcatgagaaccgtaagaacatgtattcagatgaggcgaagtccacggcagtggcattccgcctcattcatgaaaacctcccacgtttcatcgacaacaaaaaagtgtttgaggaaaagatcatgaacagcgaacttaaagataaattcccagaaatcttgaaggagcttgaacagatcttgcaggtgaacgaaattgaagagatgttccagcttgattatttcaacgacaccctgattcagaatggtatcgacgtttataatcacctcattgggggttatgcggaggaagggaaaaagaagatccaaggcctcaacgaacacatcaacttatacaatcaaatccaaaaggagaagaacaaacggatcccacgtttgaagcctctttataagcagattctgtctgaccgtgaaacagcctcatttgtcatcgaagcctttgagaacgatggggagctgttggagagcctcgaaaagtcgtatcggcttctccagcaggaggtttttaccccggagggtaaagaggggctggccaatctgcttgctgctattgccgagagcgagacgcacaagatttttctcaaaaatgaccttggtctcacagaaatttctcagcagatttacgaatcttggagtctgatcgaagaagcttggaataaacagtacgacaacaaacaaaaaaaggtgactgaaacggagacttatgtagacaatcgcaaaaaggcctttaagtccattaaatctttttcgattgcggaagtggaagagtgggtcaaagccctcggcaacgagaaacacaagggtaagagtgttgccacctattttaaaagtctgggcaagactgacgaaaaggttagtcttatcgaacaggtcgaaaacaattacaacatcatcaaggatctcctcaatacaccttaccctccgtctaaagacctggcacaacaaaaagacgacgttgagaagatcaaaaattacttggactcgctcaaggccctccaacggtttatcaagccacttttaggttctggcgaagagagtgacaaagatgcccacttctatggggaattcactgctttttgggatgtcctcgacaaggtaactccattgtacaacaaagtacggaattatatgaccaagaagccttattccaccgaaaaatttaagctcaattttgagaatagttatttccttaatggctgggcacaagactacgagacgaaggcaggcctgatttttttgaaagacgggaactacttcttagccatcaacaataaaaagcttgacgaaaaggaaaaaaaacaacttaagacgaattatgagaaaaacccagcaaaacggattattttagatttccagaagccagacaacaagaacattccgcgcttatttatccggtcaaaaggggacaatttcgctccagctgtggagaaatataacttaccaatcagcgacgtcattgacatttacgatgagggtaagttcaaaaccgagtaccggaaaatcaacgaaccagagtatcttaagtctctgcacaagctgatcgactattttaaacttgggttttcaaagcacgaatcgtacaaacattacagcttctcttggaagaagactcatgagtacgaaaacatcgctcaattttatcatgatgtggaggtgtcatgctaccaagtccttgatgagaatattaattgggattcacttatggagtacgtagagcagaataagctctatctttttcaaatctacaataaagatttctccccaaactcgaaaggtaccccgaacatgcataccctttactggaagatgttatttaaccctgacaatctgaaggacgtagtttacaaattgaatggccaggcggaagtgttctaccgcaaggcgtctattaagaaggagaataaaattgtccacaaagcaaatgatccgattgacaataagaacgaattaaataagaagaagcagaatactttcgagtatgacatcgtaaaagataagcggtataccgtcgacaagtttcaattccatgtgccaatcacgttaaatttcaaagcagagggcttgaataatctcaactcaaaggtaaacgaatacatcaaagaatgcgacgaccttcacatcattgggattgatcgcggcgagcgtcacctcctctacctcagtctcattgacatgaaggggaatatcgttaagcagttcagtctcaatgagattgttaacgagcacaaagggaatacttaccgcacgaattaccacaatttgcttgacaagcgggagaaagaacgtgaaaaagagcgcgaatcttggaaaaccatcgaaactatcaaggaattaaaggaagggtacatctcccaggttgtacataagatcacgcaattgatgatcgaatataatgcgattgtggtgttggaagacttgaattttggttttaagcgtggccgttttaaggtagagaaacaggtgtatcaaaagttcgagaaaatgcttattgataaattgaactatctcgtggacaagaaaaaggaagctaatgaatcaggtgggacgttgaaggcataccaacttacagattcttatgccgactttatgaaatacaagaaaaagcagtgcggttttctcttttatgtcccggcatggaatacctctaagatcgaccctaccacgggttttgttaacttgttcgatactcactacgtcaacgtatccaaggctcaagaattcttctccaaattcaagagcattcgctataacgcggccaataattactttgagttcgaggtaaccgactacttcagcttctccggcaaagctgagggtacgaagcagaactggattatctgtacccatgggacacggatcatcaattttcgtaatcctgaaaaaaacagccagtgggacaacaaagaagtagttatcactgatgaatttaaaaagttgtttgaaaagcacgggatcgattacaaaaattcatcagaccttaaagggcagattgccagccaaagcgaaaaggcattctttcataacgagaaaaaggacacaaaggatccagatggcttactgcagttgttcaaacttgcactgcagatgcggaactccttcattaaatcagaggaggattacctggtatcacctgtaatgaacgacgaaggcgaatttttcgactctcgtaaagctcaacctaatcaaccagagaacgccgatgccaacggcgcatataacattgcgatgaagggcaaatgggtagtgaagcaaatccgtgagtccgaggatttagataaactcaaattggcaattagtaacaaggaatggctgaactttgcacaacggagtggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1058 - DNA, 4092 bp, synthetic construct
  misc_feature 1..4092: note = Description of Artificial Sequence: Synthetic polynucleotide
  source 1..4092: mol_type = other DNA
atgggccaccatcatcatcatcatagcagcggcctggtgccgcgcggcagcggtaccatgaaaaacatggagtcgttcatcaatttatatcctgtttcaaagacactgcgttttgaattgaaacctatcggcaaaacgcttgagaccttcagtcggtggattgaggaactcaaagaaaaggaggccatcgaactgaaggaaacgggcaaccttttagctcaggatgagcaccgggcagagtcttataaaaaggtgaaaaaaatccttgacgaatatcataaatggttcattacagaatctctgcaaaacaccaagcttaacggcctcgacgttttttaccataattatatgcttcctaagaaggaggatcatgagaagaaagccttcgcatcttgtcaagataaccttcggaagcaaattgtgaacgcgttccgtcaggaaactggcttatttaataagctgtcaggtaaagaactctttaaggacagtaaggaagaagttgcactcttgaaggccattgtaccttactttgataacaaaacgctcgaaaatattggcgtaaaatcgaatgagggtgccttgttattaattgaagagtttaaagactttacaacatattttgggggttttcacgaaaaccgtaaaaacatgtattccgatgaagcgaaatcgactgccgtggcttttcgcttgattcacgagaatttaccacgctttattgataataagaaagttttcgaggagaaaattatgaatagtgaactcaaggataagtttccagagattttaaaagagctcgaacaaatcttacaggtgaacgagatcgaagaaatgttccagttagactattttaacgatactttaattcagaatgggattgacgtttataaccacctgatcggtgggtatgctgaagaaggcaagaaaaaaatccaggggctgaatgaacacattaatctttataaccaaattcagaaagaaaaaaataagcggatcccgcgcctcaaaccattatacaagcagatcctttcagatcgcgagacagcatcatttgtgattgaagcattcgaaaacgacggggaactgttagagtcgctggagaagagttaccggttgctccaacaagaagtattcaccccggagggcaaagaaggtcttgccaacctcctggccgctatcgcggagtcagaaacgcacaaaatttttttaaaaaatgacttagggttaacggagatttctcagcagatctacgaaagctggtcacttattgaagaagcttggaataagcaatacgacaataagcaaaaaaaggttacggagacggagacgtatgttgataatcgtaagaaggcctttaaatcgattaagtcattttcaattgccgaggtagaggaatgggtaaaggcactcggcaatgagaaacataaaggtaagagcgtagcaacctattttaaatccttgggcaaaacggacgagaaagtgtcgttaatcgagcaggtggagaacaactataatattattaaggatcttctgaataccccgtatccgccatctaaagatcttgcacagcagaaagacgacgtagaaaagatcaagaactacttggatagtctgaaggccttacaacggtttattaaacctttgctcggctcaggcgaagagtcggacaaagatgcgcacttttacggtgagtttactgccttttgggatgtattggacaaggtaacccctctttataacaaggtccgcaattacatgaccaaaaagccgtattcaacagagaaatttaaactgaatttcgaaaacagttattttttaaatggttgggcgcaagattatgaaaccaaggccggtcttatctttctgaaagacggcaactattttctcgctattaacaacaagaagctggatgagaaggaaaagaagcaattaaaaactaactacgagaagaacccagcgaagcgcatcattcttgattttcagaagcctgacaataagaacatccctcggttgttcatccggtcaaagggtgacaatttcgcccctgcagtggaaaagtacaacttacctatctcggacgtcatcgacatctacgacgaaggcaagttcaagacggagtaccgcaagattaatgaacctgaatacttaaaatccttacataaactcattgattatttcaaattggggttttcgaagcatgagtcttacaaacactactcgttctcttggaaaaaaactcacgaatacgaaaatatcgcccagttttatcatgacgtcgaagtaagttgctatcaagtcctggatgagaatattaattgggatagtttaatggagtacgttgaacaaaataaactgtatttgtttcagatttataacaaagatttttctccgaacagtaagggtactccgaacatgcacacactgtactggaagatgctctttaaccctgacaacttgaaggatgtggtctacaagctcaatgggcaagctgaagtgttttatcgcaaggcatcaattaaaaaagaaaataagatcgtccacaaagccaatgacccaattgacaataaaaacgaactcaacaagaaaaaacagaatacttttgagtatgatattgtgaaggacaaacgctacacagtggataagttccaatttcatgtacctatcacactcaactttaaagcagagggtcttaataatctgaacagcaaagtgaatgagtacattaaggaatgtgatgatttacacatcattgggatcgaccgtggtgagcgtcatcttctttacttgtccttgattgatatgaaggggaacattgtgaagcaattctcattaaacgagattgtcaacgagcacaagggtaacacgtatcgcacaaattatcacaacctgcttgacaaacgtgaaaaggaacgcgaaaaggaacgtgaaagttggaaaaccatcgaaaccattaaggaactgaaggagggttatatcagtcaggtggtgcacaaaatcacacagctgatgatcgagtacaatgcgattgttgtcctggaagacttaaatttcgggtttaagcgcgggcgtttcaaggttgagaagcaggtctatcagaagttcgagaagatgctgattgacaaacttaattatctcgttgataagaagaaggaagctaacgagtccggtgggacattgaaagcgtatcaattaacagatagttacgcggactttatgaaatataaaaaaaaacagtgtggctttttgttttatgttccagcctggaacacgtcaaaaatcgaccctacaaccgggtttgttaacttatttgacactcactacgtaaacgtcagcaaggctcaagaattcttttctaaatttaagtccattcggtacaatgcagccaataattatttcgagttcgaagtcacagattacttcagcttcagcggcaaagcggaagggactaagcaaaactggatcatttgcacgcacgggacgcggattattaattttcgtaatccggagaagaattcccaatgggataataaggaggtcgtcattacagacgagttcaagaagctctttgagaaacatggtattgattacaaaaactcatccgatcttaaagggcaaatcgcttctcaatcagagaaggcgttttttcacaatgagaaaaaggacacgaaggacccagatggcttactgcaattgttcaagctcgcactgcaaatgcggaactcctttattaagtcggaagaggattacctggtctcgccagtgatgaacgatgaaggtgagttctttgatagccgtaaggctcagccaaatcagccagaaaacgctgatgcgaatggtgcgtataacatcgctatgaaaggcaagtgggtagtaaaacaaattcgcgagtcagaagatttggataagctcaagcttgcgatttccaataaggagtggctgaatttcgctcaacgtagcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1059 - protein, 1252 aa, synthetic construct
  REGION 1..1252: note = Description of Artificial Sequence: Synthetic Cas12a/Cpf1 [Parabacteroides distasonis] sequence
MKNILEQFVGLYPLSKTLRFELKPLGKTLEHIEKKGLIAQDEQRAEEYKLVKDIIDRYHKAFIHMCLKHFKLKMYSEQGYDSLEEYRKLASISKRNEKEEQQFDKVKENLRKQIVDAFKNGGSYDDLFKKELIQKHLPRFIEGEEEKRIVDNFNKFTTYFTGFHENRKNMYSDEKESTAIAYRLIHENLPLFLDNMKSFAKIAESEVAARFTEIETAYRTYLNVEHISELFTLDYFSTVLTQEQIEVYNNIIGGRVDDDNVKIQGLNEYVNLYNQQQKDRSKRLPLLKSLYKMILSDRIAISWLPEEFKSDKEMIEAINNMHDDLKDILAGDNEDSLKSLLQHIGQYDLSKIYIANNPGLTDISQQMFGCYDVFTNGIKQELRNSITPSKKEKADNEIYEERINKMFKSEKSFSIAYLNSLPHPKTDAPQKNVEDYFALLGTCNQNDEQPINLFAQIEMARLVASDILAGRHVNLNQSENDIKLIKDLLDAYKALQHFVKPLLGSGDEAEKDNEFDARLRAAWNALDIVTPLYNKVRNWLTRKPYSTEKIKLNFENAQLLGGWDQNKEPDCTSVLLRKDGMYYLAIMDKKANHAFDCDCLPSDGACFEKIDYKLLPGANKMLPKVFFSKSRIKEFSPSESIIAAYKKGTHKKGPNFSLSDCHRLIDFFKASIDKHEDWSKFRFRFSDTKTYEDISGFYREVEQQGYMLGFRKVSEAFVNKLVDEGKLYLFHIWNKDFSKHSKGTPNLHTIYWKMLFDEKNLTDVIYKLNGQAEVFYRKKSLDLNKTTTHKAHAPITNKNTQNAKKGSVFDYDIIKNRRYTVDKFQFHVPITLNFKATGRNYINEHTQEAIRNNGIEHIIGIDRGERHLLYLSLIDLKGNIVKQMTLNDIVNEYNGRTYATNYKDLLATREGERTDARRNWQKIENIKEIKEGYLSQVVHILSKMMVDYKAIVVLEDLNTGFMRNRQKIERQVYEKFEKMLIDKLNCYVDKQKDADETGGALHPLQLTNKFESFRKLGKQSGWLFYIPAWNTSKIDPVTGFVNMLDTRYENADKARCFFSKFDSIRYNADKDWFEFAMDYSKFTDKAKDTYTWWTLCSYGTRIKTFRNPAKNNLWDNEEVVLTDEFKKVFAAAGIDVHENLKEAICALTDKKYLEPLMRLMTLLVQMRNSATNSETDYLLSPVADESGMFYDSREGKETLPKDADANGAYNIARKGLWTIRRIQATNCEEKVNLVLSNREWLQFAQQKPYLND

SEQ ID NO: 1060 - DNA, 3759 bp, synthetic construct
  misc_feature 1..3759: note = Description of Artificial Sequence: Synthetic Cas12a/Cpf1 [Parabacteroides distasonis] sequence
  source 1..3759: mol_type = other DNA
atgaaaaatatattggaacaattcgtaggattatatcctttgagtaagacactgcggtttgaactaaaacccttgggcaagacattagagcatatcgagaaaaaaggtcttattgcgcaagacgagcaaagagcggaagagtacaaacttgtcaaggatattatcgaccgttatcataaggcatttattcatatgtgtctaaaacatttcaaattgaaaatgtattcagaacaaggttatgactctttagaagaatataggaaactggcctctatctccaaacgtaatgaaaaagaagaacaacagtttgataaagtaaaggaaaacttacgcaaacaaattgtcgatgctttcaagaatggtggctcgtatgatgatttgtttaagaaagaactaatacagaagcatctgcctagatttatagagggagaagaagagaaacgaatagttgataacttcaataaatttaccacatacttcaccggttttcatgaaaaccggaagaacatgtattcggatgagaaggaatcaacagccattgcctatcggttaatacatgagaatcttcccttgtttttggacaatatgaaatcgtttgccaaaatagcagagagtgaagtagctgcccggtttactgaaatagaaacggcataccgcacatatctcaatgtggaacacatcagtgaactgtttacgcttgactatttttctactgtgctgacacaagaacagatagaagtttataacaatatcattggtggccgtgtggatgatgacaatgtcaagatacaagggcttaacgagtatgtgaacctttataaccaacagcaaaaagaccgtagtaaacgactgcctttattaaagtcactctataagatgattcttagtgatcgtatagctatttcgtggctaccagaagagtttaagagtgacaaggagatgattgaggccattaataatatgcatgatgacttgaaagacattcttgccggtgacaatgaggattcattgaaatcattactacagcacatcggacaatatgacctttctaaaatttatattgccaacaatccagggcttacggatatttcacaacagatgttcggatgctatgatgttttcacaaatggaatcaaacaagaactccgcaactctatcactcccagtaaaaaggaaaaagccgacaatgaaatatatgaggaaagaataaacaaaatgttcaagtcggaaaagagtttcagcatagcgtatctaaacagcttgccacatcccaaaacagatgctccccaaaagaatgtggaagattattttgccctgcttggcacttgtaaccagaatgacgagcaaccgataaacctatttgcacaaatagaaatggctcgtcttgtcgcatcggatattcttgctggccgacatgtcaacctcaaccaatcagaaaacgatatcaagctaataaaagatttgcttgatgcctataaggcattgcagcattttgtcaagcccttgttaggcagcggcgatgaggccgaaaaagacaatgagtttgatgcccgtctgcgtgcggcttggaatgcgctggatattgtaacccctttatataacaaggtgcgcaattggctgactcgcaagccgtatagcacagaaaagataaaattgaattttgaaaatgcgcagttgctgggaggttgggatcagaacaaagaaccagactgcacttctgtattgttgcgtaaagatggtatgtattatcttgccatcatggataaaaaagccaatcatgcgttcgattgtgattgtctgccttcggatggcgcttgttttgaaaaaattgactacaaactattgcccggagcgaacaagatgcttccaaaggtattcttctcaaagtcacgcataaaagaattctccccttccgaaagcatcatcgcagcctataaaaaaggcacccataaaaaaggtccgaatttcagtctgtcagactgtcatcgactgatcgacttcttcaaggcatctattgacaagcacgaagactggagcaaattccggttcagattctccgatacgaaaacttacgaagacatcagtggattttatcgtgaggtagagcaacaaggatatatgcttggctttagaaaggtctctgaagcatttgtcaacaaactggtcgacgaaggtaaactttatctgttccatatatggaacaaggatttctcgaaacatagcaaggggacgcctaatctgcatacgatatactggaagatgctgttcgacgagaaaaacctaactgatgtaatatataaactgaatggccaagcagaagtattctatcgtaagaagagtctcgaccttaacaagaccacgacacataaggcacacgcgcccattacgaacaagaatacacagaatgccaagaaaggcagcgttttcgattacgacatcataaagaaccgtcgttatacggttgacaagttccagtttcatgtgcctataaccctcaactttaaggcaaccggacggaattatatcaacgagcatacgcaggaagccatacgaaacaacggtattgagcatattatcggcattgaccgtggtgaaagacatctgctctatctgtcactaatcgatttgaaagggaatatcgtaaagcaaatgacactgaacgacattgtcaatgagtataacggacgcacctatgccacgaattacaaagacctccttgccacacgagagggagaacgcacagatgcacgccgcaactggcagaaaatagagaacataaaagagattaaggaaggttatctcagtcaagttgtccatattctctccaagatgatggtggactataaagcaatcgtagtgcttgaagatttgaatacgggattcatgcgcaaccgtcagaaaatagaacggcaagtgtatgaaaaattcgaaaagatgcttatcgacaaactgaactgctatgtagacaagcagaaggatgccgatgaaacgggaggcgcattgcatccgctccaactcaccaacaaatttgaaagcttccgcaaactcggtaaacagagcggctggctgttctatattcccgcatggaacaccagtaagatagaccctgtcaccggtttcgtgaacatgctcgataccaggtatgagaatgcagacaaggcaagatgttttttctcgaaattcgattctatccgatataacgctgataaggattggtttgaatttgccatggactacagcaaatttaccgacaaggcaaaggatacgtacacttggtggacactttgttcctacggaacacgaatcaagaccttccgcaacccggccaagaacaatctgtgggataatgaggaagttgttctgaccgatgaatttaagaaagtttttgcagctgccggcatagatgttcacgaaaacctgaaagaagccatttgtgcattaaccgacaagaaatatcttgagccgttgatgcgcttaatgaccctattagtacaaatgcgcaacagtgccaccaactcggaaacggattatctgctctcgccagtagccgatgaaagcggaatgttctatgacagtcgggaaggcaaggaaacgctgcccaaggatgctgatgccaatggtgcgtacaacattgcccgaaaaggcttgtggactatccgtcggatacaggcgacaaactgtgaggagaaagtaaatcttgtcctatctaacagagaatggctgcagtttgcccaacaaaaaccttatctgaatgactga

SEQ ID NO: 1061 - DNA, 3948 bp, synthetic construct
  misc_feature 1..3948: note = Description of Artificial Sequence: Synthetic polynucleotide
  source 1..3948: mol_type = other DNA
atgggccaccatcatcatcatcatagcagcggcctggtgccgcgcggcagcggtaccatgaagaatatcctcgaacaatttgtcggtctttatccacttagcaagactctgcgcttcgaactgaagccacttgggaagacattggaacatatcgagaaaaaggggctcattgcccaagacgaacaacgcgccgaagagtataaactggtaaaggacattatcgatcgctaccataaggcattcatccacatgtgcttgaaacattttaaattaaagatgtattccgaacaggggtacgatagtttagaagaatatcggaaactggcctccatcagcaaacgcaacgagaaggaggaacaacagttcgataaggtcaaggaaaatttgcggaagcaaattgtcgatgcgttcaagaatggcggctcgtatgacgatttgtttaaaaaagaattaatccaaaaacacttaccacgtttcattgagggggaggaagaaaagcggatcgtggacaattttaacaaattcaccacttatttcaccggttttcatgaaaatcgcaaaaatatgtactctgatgaaaaggaatcgacggcaatcgcctatcgtctgattcacgaaaacttaccattattcctggacaatatgaaaagtttcgcgaaaatcgcagagtcggaagtggcggcgcggtttacagaaatcgaaactgcgtatcgcacgtatttaaacgtagaacacattagtgagctttttacattagactacttctccactgtactgacacaggaacaaatcgaggtctataacaacatcattggcggccgcgtcgacgacgataatgtcaagattcagggtctcaatgaatatgttaacttatataaccaacaacaaaaagaccggtcgaaacggctgccactcttaaaaagtctgtataaaatgattttaagcgaccgcattgcgatttcgtggttgcctgaagagtttaagtcggacaaagagatgattgaggctattaacaacatgcatgatgatctgaaggatatcttagccggcgacaatgaggactcactcaaaagtctgcttcagcacattggtcaatatgacttgtccaaaatttatattgctaataatccgggccttacagacatctcgcagcaaatgtttgggtgctatgacgtattcacaaatggtatcaagcaggagttgcgtaactcgatcacgccttccaagaaggaaaaagcagataacgaaatttatgaggagcggattaataagatgttcaagtcggagaagagcttctcaattgcatatctgaactcgttgccgcatccgaaaactgatgccccacagaagaatgtagaggactactttgccctgctcggcacatgtaatcaaaacgacgaacaaccaatcaatttattcgcccagattgagatggcgcgcttggtggcgtccgacattctcgcgggccgccatgtaaatcttaatcagtcggaaaacgacattaagcttattaaggacctgctcgatgcctacaaagctttacagcacttcgttaaaccactgttgggttcgggtgatgaagctgagaaggataatgaatttgatgcccgcctccgcgcggcctggaacgcactcgacattgtaacacctctttacaataaagtacggaattggcttacgcgtaaaccttattcgacggagaagattaagctcaactttgaaaatgctcagcttttaggtggctgggaccagaacaaagagccagattgcacgtctgtacttctccgcaaagatggcatgtattatctcgccattatggacaaaaaggctaatcatgcgtttgattgcgattgtttaccttcggatggtgcttgctttgaaaaaattgattacaaactcctgccaggggcaaacaaaatgctcccaaaagtgttctttagtaaatcccgtatcaaggagttttcgccttccgagagcatcattgccgcttacaaaaaaggtacccacaaaaaaggtccaaacttttctctttcggactgccaccgtctcatcgatttctttaaagcttcaattgacaaacatgaggattggtctaagttccgttttcggttctcggataccaaaacctacgaggatatctcaggcttctaccgggaggttgaacagcaggggtatatgctgggctttcggaaggttagtgaagcttttgtaaataagcttgtagatgagggtaaactctatctcttccatatctggaacaaagatttctcgaagcattccaaagggaccccaaacttgcatactatctattggaaaatgcttttcgatgaaaagaacttgacggacgttatttacaagctcaacgggcaagctgaagtcttctaccggaaaaaatctctcgacttaaacaagacgacgactcacaaggcccacgcacctattacgaacaagaatactcaaaacgcgaagaaaggctccgtatttgattacgacatcattaaaaaccggcggtatactgtcgataagtttcagtttcatgtgccaatcaccttgaatttcaaggcgacgggtcgtaactacatcaatgagcatactcaagaagctattcgtaacaatggcattgaacatattattgggatcgaccgcggggagcgtcacctgttgtatttgtcgctgatcgatctgaaagggaatatcgtcaagcagatgaccttgaatgacatcgtcaatgaatataacgggcgcacctacgctactaactacaaagaccttctggcaacgcgcgagggcgaacgcacggatgctcgccgcaactggcagaaaattgagaacatcaaggaaatcaaggagggttacttaagccaggtagttcatattctctcaaagatgatggtagattacaaggcgatcgtggtgttggaagacttaaatacaggctttatgcgtaatcgccaaaaaatcgaacggcaagtatacgagaaatttgagaaaatgttgatcgataaactcaattgttacgtcgataaacaaaaagacgcggacgaaacgggcggggctttacacccacttcagcttaccaataaatttgaaagttttcgtaaactggggaagcagagtggctggttattctatatcccggcatggaacacatcgaaaattgacccggtcacgggttttgttaatatgctggatacccgctacgagaacgccgacaaagcccggtgttttttctctaagttcgactccattcgctacaatgcagacaaagattggtttgagttcgctatggattactcgaaatttacagacaaagccaaagacacttatacctggtggacactctgtagttacgggacccgcatcaaaacttttcggaatccggccaagaacaacctctgggataatgaggaggtggtactcaccgatgagtttaaaaaggtctttgcggcagcgggtatcgatgtccatgaaaacttgaaagaagccatctgcgccttgactgataaaaaatacctcgaaccactgatgcgtttaatgacgttacttgttcagatgcgcaattcggcaacaaactcggagactgactacttgttgtcccctgtggccgacgagtcaggtatgttttatgattcacgtgaagggaaggaaaccttaccgaaagatgcggacgccaacggtgcttataacattgcccgcaagggcttgtggaccatccgtcgcatccaggccacgaattgcgaggagaaagtcaaccttgtgttgtcaaaccgggaatggttacagtttgcgcaacaaaagccttatctcaacgatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1062 - DNA, 3948 bp, synthetic construct
  misc_feature 1..3948: note = Description of Artificial Sequence: Synthetic polynucleotide
  source 1..3948: mol_type = other DNA
atgggccaccatcatcatcatcatagcagcggcctggtgccgcgcggcagcggtaccatgaaaaacattttagaacaatttgttggtttatatccgctttccaagacgctccggttcgagttaaagccgttgggcaagacactggagcatattgagaagaagggtttgattgcgcaggatgagcaacgcgcggaggaatataaactggtaaaagacattatcgatcgctaccataaagcattcattcacatgtgcctgaaacattttaaattgaaaatgtacagcgagcaagggtatgacagtcttgaggagtatcgtaagctggcatcgatttcaaagcgtaacgagaaagaagagcaacagtttgacaaggttaaggagaacttacgtaaacaaatcgtagatgcgtttaagaacgggggttcgtacgatgacttgttcaaaaaagaattaatccagaagcacttgccgcgcttcattgagggcgaggaagagaaacgcatcgtggacaacttcaataaatttacaacttacttcaccggcttccacgaaaaccgtaagaatatgtattcagacgaaaaggaaagtactgccattgcctatcggctgatccacgaaaaccttccactcttcttggataatatgaaatcttttgcgaaaatcgcggagagcgaggtcgccgcccgcttcaccgaaatcgagacagcctaccggacgtacctcaacgtagagcatatctccgagttattcacattggattacttctcgaccgtacttacccaagaacaaatcgaagtttacaacaacatcatcggtggccgcgtcgacgatgataacgtaaagatccagggccttaacgagtatgtcaacctgtacaatcagcagcagaaagatcgcagcaagcgcctgccattattgaaatcgctttataagatgattctgagtgaccgcatcgcaatctcctggcttcctgaggagttcaagtcagataaagagatgatcgaggcaatcaacaacatgcacgatgatttgaaggacattcttgctggtgataatgaggactcgttgaaatcgctcttacaacatattggtcaatacgatttaagcaagatttacattgctaacaatccaggtctgacagatatcagccagcagatgtttggctgctacgatgttttcaccaatggcattaagcaagagctccggaacagcattactccttccaagaaagagaaggcggacaatgaaatttacgaggagcgtattaataagatgttcaagtcggagaagtcgttcagcattgcgtaccttaattcgttaccacacccaaaaactgacgcgcctcaaaaaaacgtggaagactatttcgcactgctcggcacttgtaaccaaaacgatgagcaacctattaatctgttcgctcagattgagatggctcgtctcgtagcgtccgatattctcgcgggccgtcatgtcaatctgaaccaatccgagaatgacattaaattgatcaaggacttactggacgcgtataaggcgctgcagcactttgtgaagcctttgttaggttcgggcgatgaggcagaaaaggataacgagtttgatgcccgtctccgggccgcatggaatgcgttagacatcgtgactcctctgtacaataaggttcgtaactggttgacgcggaagccttattccacggagaagatcaaattgaactttgaaaatgcacagttgcttggggggtgggaccagaataaggagcctgattgtacttctgttttattacgtaaggatggtatgtactacttagcaattatggataagaaagcaaatcatgcgttcgattgcgattgtctcccttccgatggggcttgcttcgaaaagatcgactacaaacttctcccgggcgcgaataagatgttgcctaaagttttcttttctaagagccgcatcaaagaatttagtccaagcgagagcatcatcgctgcttacaagaaaggtacgcataaaaaaggtcctaacttctccttatcggattgccatcgtctcatcgacttcttcaaggcctctattgacaaacatgaagactggtctaagtttcgttttcgtttctcagacactaagacatacgaagacatttccggtttttatcgcgaggtggagcaacaggggtatatgttaggttttcgcaaggtaagtgaggcatttgtgaacaagcttgtggacgagggtaagttatatttatttcacatttggaacaaggacttctcaaagcacagcaaggggacgcctaatctgcataccatctactggaaaatgctgttcgacgaaaagaatctcacggacgtgatctacaagttgaacggccaggcggaggtgttctatcgcaaaaagagtttagatttgaacaagactaccactcacaaggcgcatgccccaattacaaacaagaacacccaaaacgcaaaaaagggctctgtgttcgactacgatattattaagaaccggcgttataccgttgacaagttccaattccacgtgcctatcactttaaacttcaaggctactggccgtaactatatcaatgagcatacacaggaggcaatccggaataatggtatcgagcacatcattggtattgatcgcggggagcgccacttattatacctttcccttatcgacttaaaggggaacattgttaagcagatgacattaaatgatatcgtaaacgagtataatggccggacttatgctacgaattacaaagacctcctggccacacgggaaggcgaacgcaccgatgcccgccgcaactggcaaaaaatcgagaatattaaggagattaaagagggctacttgtcccaggtcgtccacatcctgtcgaaaatgatggtcgactacaaagctatcgtcgtcttagaagacttgaacacaggttttatgcgtaaccgtcagaaaatcgaacggcaagtttatgagaaattcgaaaaaatgttgattgacaagttaaattgctatgttgacaagcagaaggacgcggatgaaacagggggggcattacatccattgcagttgaccaacaaattcgagtcgttccgtaaactcggcaaacagtctggttggctcttctacattcctgcctggaatacatcgaaaattgacccggtgacgggctttgtaaacatgttggatacacggtatgagaacgcggacaaggcccgctgtttcttttctaaatttgactcgatccggtacaatgcagacaaagactggttcgagttcgctatggattattcaaaatttactgacaaggctaaggacacctatacgtggtggacgctctgctcttatggcactcggattaagacgttccgcaatcctgcaaaaaacaatttatgggacaatgaagaagtagtacttaccgatgagttcaagaaagtttttgcagccgctggcatcgatgtacacgaaaatcttaaggaggccatctgtgccttaacagataagaagtatttagaaccattaatgcgcttaatgacactccttgtgcagatgcgcaacagtgcgaccaacagcgaaaccgattacttactgtctccggttgctgatgagtcaggcatgttttacgactcccgggaggggaaagagacccttcctaaagacgccgatgcaaacggcgcctataatatcgcacgcaagggcttatggactattcgccgtattcaggcaacgaactgcgaagaaaaggttaacttagtgttaagtaaccgtgagtggctccaattcgcgcagcagaagccttacttaaatgatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1063 - DNA, 3948 bp, synthetic construct
  misc_feature 1..3948: note = Description of Artificial Sequence: Synthetic polynucleotide
  source 1..3948: mol_type = other DNA
atgggccaccatcatcatcatcatagcagcggcctggtgccgcgcggcagcggtaccatgaaaaacattcttgagcaattcgttggtctttatccgttatccaaaaccctgcgctttgaattaaaacctttaggtaaaacactggagcacatcgagaaaaaagggcttatcgcacaggacgagcaacgcgcagaagaatacaagctcgtgaaggacatcattgaccgctaccacaaggctttcatccacatgtgcttaaaacattttaaattaaaaatgtacagtgagcaggggtatgattcgctggaagagtatcggaagctggcatctatcagcaaacgtaacgaaaaggaggagcaacagttcgacaaagtcaaagagaatctccggaaacagattgttgacgctttcaaaaatggcgggagctacgacgacttgtttaagaaggaactgattcagaagcacttaccgcgcttcatcgagggtgaagaggagaagcggatcgtagataacttcaacaagttcaccacctatttcacgggctttcatgaaaaccggaagaacatgtatagtgacgaaaaagaatcgacagctatcgcttaccgtcttatccacgagaacctccctctctttctggataatatgaagtcgttcgcgaagattgcggaatccgaggtagcggcccgtttcacggaaattgagactgcttaccggacttatttgaatgtagagcacatttcggagttatttacacttgactatttctccaccgtgctgacacaggaacagattgaagtttacaataacatcattggtggccgcgttgacgatgataatgttaagattcagggcttaaacgaatacgtgaacctctataaccaacaacagaaagatcgtagtaaacggctgccattgttaaagtccctctacaaaatgattctcagcgatcgcatcgcaatctcatggctgcctgaagagttcaagagtgataaggagatgatcgaggctattaataacatgcatgacgatttgaaagacattcttgcaggcgataatgaggacagtttaaagagcttgttacaacatattggtcagtacgatttgtccaaaatttacattgcaaacaatcctgggttaactgatatctcccagcagatgtttgggtgctacgatgtatttacgaacgggattaagcaagagttgcgcaatagtatcactccgagcaaaaaagagaaggcagacaatgagatttatgaagagcgtatcaataaaatgtttaagtccgaaaagtcattttcaatcgcctatctcaatagtctcccgcatccaaagacagatgccccacagaagaacgtggaagattatttcgcgcttctgggtacctgcaatcagaatgatgagcagccgattaatcttttcgctcaaattgaaatggcccgcctggtggcatcggatatccttgctggccggcatgtaaatcttaaccaaagcgaaaacgatattaaactgattaaggacttattagatgcttataaggcacttcagcacttcgtcaaaccattacttgggagtggggatgaggctgaaaaggataatgaattcgacgctcggttacgtgcggcgtggaacgccttggatattgttactccactttataacaaagtacgtaattggctgacgcgcaagccgtatagtacggagaagattaaactgaattttgaaaatgcgcagttactggggggctgggatcaaaacaaagaaccggattgcacgagcgttctgcttcgtaaagatgggatgtattacctggccatcatggataagaaagcaaatcacgcttttgattgtgactgtttaccgtcggacggtgcatgtttcgaaaaaattgactataaattactgccgggtgcgaacaagatgctgcctaaggtctttttctcgaagtcccgcatcaaagagttctccccttcggagagtatcatcgctgcctataaaaagggtactcataagaaggggcctaattttagtctctcagattgccaccgcttaattgacttcttcaaggccagtattgacaaacatgaggattggtctaaatttcgcttccggttcagtgatacgaaaacgtatgaagatattagcgggttttatcgcgaggtcgaacagcaggggtacatgctgggtttccggaaggtgtcagaggcctttgttaacaagttagttgatgaaggcaaactttatttatttcatatctggaataaagatttctcgaagcattcgaaagggacaccaaatctgcatactatctactggaagatgctgtttgatgagaaaaaccttacagacgtgatttataagctgaatgggcaagcagaggtcttttaccgtaaaaagtctctggatctcaacaagaccacaacacacaaagctcacgcgccaattacgaataagaacacgcaaaatgcgaagaaaggctctgtgtttgactacgacattatcaaaaatcgtcgctacaccgttgacaaatttcaatttcacgtgccaattaccctcaacttcaaggcgacggggcggaattacatcaacgaacacacccaagaagctatccggaataatggtattgagcacatcatcgggattgatcggggggaacgccacttgctttatctttctttgattgatctcaaaggtaacatcgtcaaacagatgacgcttaatgatatcgtaaatgagtacaacgggcgtacatacgcgactaattataaagatcttttggctacccgcgaaggggaacgtacggatgcgcgccgcaactggcaaaaaatcgaaaatattaaggagattaaggagggctatctgtcgcaggtagtacacatcctgtcgaaaatgatggtcgattacaaagctattgtcgttcttgaggatttaaataccggtttcatgcggaatcggcaaaaaattgaacgccaggtgtacgagaaattcgaaaaaatgctcattgataaattgaactgctacgttgataaacaaaaagacgcggatgagacgggcggtgctctccacccattgcaactgacaaacaagtttgagagctttcgtaaattaggcaagcaaagtggttggctgttctatatcccagcatggaataccagcaagattgacccagtcacagggtttgttaacatgctggatactcgttatgagaacgcagacaaagcgcgttgcttcttcagcaagttcgatagtattcggtacaatgcagacaaggactggttcgaatttgcaatggactactccaaatttacagacaaggccaaggacacatacacttggtggactctctgctcgtacggcactcgtatcaagacatttcgcaacccggcgaagaataacctgtgggacaacgaagaggttgtcctgacggacgagtttaagaaggtgttcgcagccgcggggatcgatgtccatgaaaacttaaaggaagctatttgcgcacttacggataaaaaatatctggagccacttatgcggttaatgactctcctcgttcaaatgcgcaatagcgctaccaacagtgagacagactacttattatcccctgtggcggacgagtcaggcatgttttatgactctcgggaagggaaggagacgctcccgaaggacgccgatgctaatggcgcgtacaacattgcccgtaagggtttatggaccatccgtcgcatccaagcaaccaactgcgaagaaaaagtaaatcttgttctgtcgaaccgcgagtggcttcaattcgcccaacagaaaccttacttgaatgacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1064 - DNA, 3948 bp, synthetic construct
  misc_feature 1..3948: note = Description of Artificial Sequence: Synthetic polynucleotide
  source 1..3948: mol_type = other DNA
atgggccaccatcatcatcatcatagcagcggcctggtgccgcgcggcagcggtaccatgaagaacattttagaacaattcgtcggcctgtatcctttgtcaaaaaccttgcgcttcgagttgaagccactgggcaaaactttagagcatatcgagaaaaagggtcttattgcccaggacgaacaacgcgcggaagagtataagcttgtcaaggatatcatcgatcgttatcataaagcgtttattcatatgtgcttgaagcattttaagctcaaaatgtactcggagcaaggttatgactcccttgaggagtaccggaagttagctagcatcagtaagcggaacgaaaaggaagagcaacaatttgacaaagtaaaagagaatttgcgcaagcaaatcgtcgatgcgtttaaaaatggtggtagctacgatgacttatttaaaaaagagctgatccaaaaacacctcccacgttttattgagggggaagaggaaaagcgtattgttgataatttcaataaatttacaacgtattttacgggttttcacgaaaatcgcaaaaacatgtactccgacgagaaggagtccacagcgatcgcctatcggcttatccacgagaatttaccgctttttcttgataacatgaaatcattcgccaagattgctgagtccgaggtggcagcccgctttaccgaaatcgagacggcataccgcacttatcttaacgttgaacatatctccgaactttttacactggactacttctcgaccgtgctgacacaggaacagatcgaggtgtataataatattatcgggggccgggtggacgatgataatgtaaaaattcaggggctcaacgaatacgtgaatttatataaccaacagcaaaaggaccgcagcaaacgtctgcctttacttaagtcactttataagatgatcttgagtgaccggattgctatctcctggttgccggaggaattcaaatctgataaagagatgattgaagctattaataacatgcatgacgaccttaaagacatcctcgccggtgacaatgaggatagtttaaaatcattgctgcaacacattgggcaatatgatttgtccaaaatctatatcgcgaacaatccgggccttactgacatttcacaacagatgttcgggtgttacgacgtttttacgaacggtattaagcaagagttacgtaattcaatcactccatccaagaaagaaaaggctgacaacgagatctatgaagaacggatcaataagatgtttaaatcggaaaaatcatttagtattgcgtacctgaatagcctcccgcacccgaagactgacgccccgcaaaaaaacgtagaagactacttcgccttgttggggacctgcaatcaaaatgacgagcaaccaatcaacctctttgctcaaatcgagatggcgcggcttgtggcgtcggatattcttgcaggccgtcacgtaaacttgaatcaatctgagaatgacattaagctcattaaagatttactcgacgcgtataaggcgctccaacattttgtgaaaccgcttcttggttcgggggacgaggcggaaaaggataacgaatttgatgcgcgtcttcgggcggcatggaacgcgctggatatcgtgacgccactttacaataaagtacgtaattggttaacacgtaaaccgtattccacggaaaaaattaagttaaattttgaaaacgcacagttgctgggggggtgggaccaaaataaggagccagattgtacatcagttctgctccgcaaagatggtatgtactacctcgctatcatggataaaaaagccaatcacgcctttgactgtgactgcctgccttccgacggggcatgtttcgagaaaatcgactacaagctcttacctggtgcgaacaagatgttaccaaaagtattcttttccaagtcgcgcattaaggaattctcaccgtccgaaagcattatcgcggcatacaagaaaggcacacataaaaagggcccaaactttagtttatccgactgtcaccggcttatcgatttcttcaaagcatccatcgataagcacgaggattggtcgaaattccggttccgtttctctgatacgaagacgtacgaggacattagtggtttttatcgcgaagtagagcagcaggggtacatgttagggtttcgcaaagtgtctgaagcatttgttaataaattggtcgacgagggcaaattatacctgtttcacatttggaacaaagatttctccaagcacagcaagggtactccgaatttacatacaatctattggaaaatgctgtttgacgaaaaaaacttgactgatgttatctacaagttgaatggccaggccgaggtgttttaccgcaagaaaagcttagatcttaataaaacaacaacacacaaggcgcatgcacctattacgaataaaaatacgcagaatgcgaagaaggggagcgtgttcgattatgacattattaaaaatcggcggtatactgtggacaagtttcaattccacgtccctatcactcttaactttaaggccaccggccggaattacatcaatgaacacacgcaggaagcaattcgtaataacggtattgagcacatcatcgggattgatcgtggcgagcgtcatcttttatacctgtccttgattgacttaaagggcaacatcgttaaacagatgaccttaaatgatatcgtcaacgagtataacgggcgtacgtacgctacgaattataaggacttgctcgctacgcgggagggcgaacgcacggatgcacgccggaactggcagaagatcgagaacattaaggagattaaagaagggtatttgagtcaggttgtgcatatcttatctaagatgatggttgactacaaagcgattgttgtattagaagatttgaatacagggtttatgcgcaaccgtcagaagatcgagcgccaggtatacgaaaagttcgaaaagatgttaatcgacaaactgaactgttacgtagataaacaaaaagatgccgacgaaactgggggggcgttacacccgcttcaattaactaataagttcgagtccttccgtaagttgggcaaacaatccggttggctcttctatatcccagcctggaacaccagtaagattgacccggtaacgggctttgtgaatatgttggatacccggtacgaaaatgctgataaagcgcggtgcttcttttctaaattcgattctattcgttacaatgccgataaggattggttcgaattcgctatggattattcgaaattcaccgacaaggcaaaagatacgtacacctggtggaccttatgttcatacgggactcggattaagacattccgcaaccctgccaagaataacctttgggataatgaagaagtagtgttgacagatgagtttaaaaaagtattcgctgcggcagggatcgatgtccatgaaaacttaaaggaagctatctgtgcattaacggacaaaaagtaccttgagccgctgatgcggttgatgacactcctggtccaaatgcggaattcagccaccaacagtgaaaccgattacttgctgtccccagtagctgatgaaagtgggatgttctatgattcgcgggagggtaaagaaacgcttccgaaggacgccgacgccaacggcgcctataatattgctcggaagggtctgtggactattcgtcgtatccaggcaacaaactgcgaggagaaggtcaacttagtgctttcaaaccgtgagtggctgcagttcgcccagcagaagccgtatttgaacgacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1065 - DNA, 3948 bp, synthetic construct
  misc_feature 1..3948: note = Description of Artificial Sequence: Synthetic polynucleotide
  source 1..3948: mol_type = other DNA
atgggccaccatcatcatcatcatagcagcggcctggtgccgcgcggcagcggtaccatgaaaaatatcttggaacaatttgtgggcctttaccctctgtccaagaccctccgctttgaacttaagcctttaggtaagactcttgaacatattgagaaaaaaggtctcatcgcacaagacgagcagcgtgcggaggagtataaattagtcaaggacatcatcgatcgttaccataaggcgtttattcacatgtgtctgaagcactttaagctcaaaatgtacagtgagcagggttacgattccttggaggagtaccgtaagttagcttcaattagtaagcgtaacgagaaagaggagcaacagttcgataaagtaaaggaaaatttacgtaagcagatcgttgatgctttcaagaatggcggcagctacgatgacttgttcaagaaagagttaattcaaaagcatttgccgcgcttcattgagggggaagaagaaaaacggattgttgacaacttcaacaagttcaccacatacttcactgggttccacgagaaccgtaaaaacatgtattccgacgagaaggaaagtaccgcgattgcatatcgtttaatccacgaaaatttaccgctttttttggataatatgaaatcattcgccaagattgctgagtcggaagttgcagctcgttttaccgagatcgaaacggcatatcgcacttacctgaacgtagaacacattagcgagcttttcactttagactatttcagtactgttttaactcaggagcaaatcgaggtctacaataacatcattggtggccgtgtcgatgatgataatgtcaaaattcaagggctcaacgagtatgttaacctttacaaccaacaacaaaaggaccggagcaagcggctcccattactgaaatcgctctataaaatgatccttagtgatcgtattgcgatctcctggcttccggaggaattcaaaagcgataaggaaatgattgaagccattaacaatatgcatgacgacttgaaggatattcttgcaggcgacaatgaggacagtctgaagtctctccttcagcatattggtcagtatgacttgtccaagatctatatcgcaaacaatcctggtttgaccgatatcagtcaacagatgtttggttgctacgacgtattcacgaatgggattaaacaagagttacgtaattccattacaccaagcaaaaaagaaaaagccgacaatgaaatctatgaagagcggattaataagatgtttaaaagtgaaaagtctttctctatcgcatacctcaactctttgcctcatccaaagactgatgccccgcaaaagaacgtggaggattactttgccttgttgggcacttgcaaccagaacgacgagcaacctatcaacttgttcgcgcagattgagatggcgcgcctcgtggcatctgacatccttgcagggcgtcatgttaatttgaaccaaagtgaaaatgatatcaagttgattaaagacttgctcgacgcctataaggcgttgcaacacttcgttaagccgctcctggggagtggcgatgaggccgaaaaagataacgaatttgatgcacggctgcgtgcggcctggaacgccttggacattgtgacaccgttgtataataaagttcggaattggctgactcggaagccatacagtacggaaaaaatcaagcttaatttcgagaacgcccagttactgggtggctgggaccagaataaggaaccagactgtacttccgtactcctgcgtaaggatgggatgtattatctggctattatggataagaaagctaatcacgctttcgactgcgattgcttaccaagcgatggtgcctgctttgaaaaaattgattacaaactcctgccgggcgccaacaagatgttaccaaaagtctttttttcaaaatcgcggattaaggagttttccccgtctgagtccattatcgcggcatacaaaaaagggacacacaaaaagggtccgaatttttccctttccgattgccatcgcctgatcgacttttttaaagcctccattgacaagcacgaggattggagcaaattccgctttcgtttcagcgatacgaaaacctacgaagacatctccggcttttatcgcgaagtggagcagcaggggtacatgttaggtttccgtaaagtatcggaagcttttgttaataaactcgtcgacgaaggtaaattatacctgttccatatttggaacaaagacttctccaagcactccaagggcacaccaaacctccacacgatctattggaagatgttatttgatgaaaagaatttgaccgatgtcatttataaacttaacggtcaggccgaggttttctaccggaagaagtctctcgacctcaataagacgacgacccataaggcacacgctccaatcactaataaaaacacgcagaacgcaaagaaggggtcggtcttcgactacgatattattaagaatcgtcggtataccgtcgataaatttcaattccatgtgcctattactttgaattttaaagcgacggggcggaactacatcaatgagcatacgcaggaggctattcgcaataatggtatcgaacatatcattggcattgatcggggggagcgccacctgctgtacctgtcactgattgatcttaaaggtaacattgtgaagcagatgacattgaatgacatcgtgaacgagtataacggtcggacctatgctacaaactataaagatcttctggccacccgtgagggtgagcggacagacgcacggcgcaactggcagaagattgaaaacattaaagaaattaaagagggctacctttctcaagttgtacacatccttagcaagatgatggtggattataaggcgatcgtggtgttggaggaccttaatacgggtttcatgcggaatcggcagaagatcgaacggcaggtatatgaaaagtttgaaaaaatgcttattgacaaattaaattgttatgttgataagcaaaaggacgcggatgaaacgggtggggcgctgcatccgctgcaactgacaaataaattcgaatctttccgtaaacttggtaaacaatcgggctggttattctacattccggcgtggaacacaagcaaaattgacccggtaacgggttttgtaaatatgctcgatacgcgctacgagaatgcagataaagcacggtgtttcttcagcaagttcgacagcatccggtataatgccgacaaagactggttcgagtttgcgatggactattctaaatttaccgacaaagcaaaggacacttatacgtggtggacattatgctcatatgggacccgcatcaaaacttttcgtaatcctgccaagaataacttgtgggacaatgaggaagtcgtgcttacggacgagttcaagaaggtatttgcggccgccggcattgatgtgcatgaaaatttaaaagaggcaatctgcgcacttactgataaaaagtacttagagccgctgatgcgtcttatgacattacttgtgcagatgcgtaatagtgccaccaattcagaaactgattacctgttatcgcctgtggcagacgaatctgggatgttctatgattcccgggagggtaaggagacgttgccaaaagacgcggacgcgaacggggcgtataatattgctcggaaggggctctggacaatccggcggattcaagcgaccaattgcgaagagaaggttaatctcgtgttgtcgaaccgggagtggcttcaatttgcacaacagaagccgtatctgaacgacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1066 - DNA, 3948 bp, synthetic construct
  misc_feature 1..3948: note = Description of Artificial Sequence: Synthetic polynucleotide
  source 1..3948: mol_type = other DNA
atgggccaccatcatcatcatcatagcagcggcctggtgccgcgcggcagcggtaccatgaagaacatcctggaacaatttgttggtctctacccactctctaagactttacgcttcgaactgaaaccgttagggaagaccttggaacatattgaaaaaaaagggctcatcgcacaggatgaacaacgtgcggaggaatacaaattagttaaggatatcatcgaccgttaccataaagccttcatccatatgtgcttaaaacatttcaaactgaaaatgtatagcgagcaagggtacgactcgctggaggagtaccgcaaattggcatcgatctctaaacgcaatgaaaaagaagagcaacagtttgataaagttaaggaaaacctccggaagcagattgttgatgcctttaagaacggtggttcatacgatgatctcttcaagaaagagttaatccagaaacacctgccacgttttattgagggggaggaggagaagcgtatcgtggataatttcaataaattcaccacctatttcactgggtttcatgagaaccgcaaaaatatgtactccgacgaaaaggaatctaccgccatcgcttatcgtctcattcatgagaatctcccattattcctcgacaacatgaaatcgttcgcgaaaatcgccgaaagcgaagtagccgctcgcttcacagagattgaaactgcctaccgtacttaccttaatgtcgaacacatttcagaattattcacgttagattacttttccacggtcctcacgcaggaacaaatcgaggtatacaacaatatcatcggggggcgtgttgatgacgacaatgtgaagatccagggcttaaacgagtacgtgaacctttataaccagcagcagaaggatcggagcaagcgtttgccattgctcaaatccctgtacaaaatgattctctctgatcgcatcgctatctcgtggttaccagaggaatttaagtcggataaggagatgattgaagccatcaacaacatgcatgatgacttgaaggatatccttgctggggataatgaagactcactcaagtccctcctgcaacacattggccagtatgatttgagtaaaatctacatcgcgaacaatccaggccttactgatatttcacaacaaatgttcggctgctacgatgtgttcacaaatggcatcaaacaggaacttcggaactctatcactccatcaaagaaggaaaaggctgacaacgaaatctacgaagagcggattaacaagatgttcaagtcagagaagagtttctcaatcgcttacctcaattctttgcctcacccaaagaccgacgcccctcagaagaatgtcgaagattatttcgctctccttggcacatgtaatcagaatgatgagcagccgattaacttatttgcgcaaattgagatggcacggttggtagctagcgatatcctcgcaggtcgccacgtaaatttgaatcagagtgaaaatgacatcaaacttatcaaagacttgttggatgcgtacaaggcgcttcaacatttcgtgaagccacttctggggtcaggtgacgaagcggagaaggacaatgaattcgatgcgcggctgcgggcagcctggaatgccttggatatcgttacgccgctctataacaaggtacggaactggttgacgcgtaaaccatactcgacggaaaaaatcaagttgaactttgagaatgcccagttactcggtgggtgggaccaaaataaagagccagactgcactagcgtactcctgcgcaaggatggcatgtactacttagcaatcatggataagaaagcaaaccatgccttcgattgtgactgtctcccttccgacggtgcatgctttgagaagatcgattataagttactccctggcgcgaataagatgttgcctaaagttttcttctccaaatcgcgcatcaaggagtttagcccttcggagagtatcattgcagcttataaaaagggtactcacaaaaagggtccaaacttctcccttagcgattgtcatcgtttgattgacttctttaaagcatcgattgataagcacgaggactggtccaaattccggtttcgcttttctgatacgaaaacttatgaggatatctcaggtttctatcgtgaggtcgagcagcaagggtacatgctcgggttccggaaggtgtccgaggcatttgtgaataagttagtggacgagggtaaactttatctttttcacatttggaacaaggacttcagtaagcattcaaaagggacccctaacttacataccatttattggaaaatgttgtttgacgagaaaaatctgaccgacgttatttacaaattgaacgggcaggcagaggtgttctaccgcaagaagtcacttgatctgaacaaaaccaccacccacaaagctcacgcgccaattacaaacaaaaacacacagaatgccaaaaaaggttcggtgttcgattatgatattattaaaaaccggcgctataccgtcgataagttccagtttcacgtgcctattacgcttaacttcaaggctaccgggcgtaactacattaacgaacatactcaagaggcgatccggaataatgggattgaacatatcattgggatcgatcgcggtgaacgccatttgctctatttaagcctcattgatttaaaagggaatattgtaaagcagatgacccttaacgatattgtgaatgaatataacgggcggacatatgcgaccaattataaagacctgctcgcaacacgtgagggggagcgtaccgacgcgcgccggaattggcagaaaatcgagaacattaaggaaatcaaagagggctacttgtcacaagtcgttcatatcttgtcaaaaatgatggtagactataaggcaatcgtggtacttgaggatttaaacactgggtttatgcgcaatcgtcaaaagattgaacgccaagtctatgagaagtttgagaaaatgctgatcgataaacttaactgctatgtcgacaagcagaaggacgcagatgagactggtggcgcacttcacccgttacagctgactaataaatttgagagctttcgtaaactcgggaaacagagcggctggttgttctatatccctgcttggaacacatcgaaaatcgatcctgtgacagggttcgtcaatatgctcgatacccgttatgagaacgctgataaagctcgttgttttttcagtaaatttgacagcattcgctataacgctgacaaagactggttcgagtttgcgatggactactcaaaattcacggataaggccaaagatacctatacttggtggactttatgttcatacggtacacgcatcaagacttttcggaacccggcaaaaaacaacctttgggacaatgaggaggtcgtacttactgacgaattcaagaaggtatttgcagccgcgggcatcgacgtccatgagaatcttaaggaggcaatctgcgcactcacagacaaaaaatatttggaacctctcatgcgtctgatgacgcttctggtgcaaatgcggaattcagccacaaactctgagacggactaccttctctccccggtcgcggacgaatcggggatgttctacgactcacgggagggtaaggagactcttcctaaagacgcggatgccaacggtgcatataacatcgctcggaaaggcctttggaccatccgtcgcattcaggctacgaattgcgaggaaaaggtaaatcttgtactctctaatcgggagtggctccagttcgctcagcaaaaaccatacctcaacgacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1067 - DNA, 3948 bp, synthetic construct
  misc_feature 1..3948: note = Description of Artificial Sequence: Synthetic polynucleotide
  source 1..3948: mol_type = other DNA
atgggccaccatcatcatcatcatagcagcggcctggtgccgcgcggcagcggtaccatgaagaatattttagaacagtttgttggtctttatccgctgtcaaaaacactccgcttcgaactgaagcctttaggtaaaacgctggagcacattgagaagaaggggcttatcgcccaagatgaacaacgcgcggaggagtataaactcgtcaaagatatcattgatcgctaccacaaggctttcattcacatgtgtttgaaacattttaaactgaaaatgtacagcgaacagggttacgactcgcttgaagaataccgcaaattagcatctatttcaaaacgtaatgagaaagaagagcagcaattcgataaagttaaagagaatttgcgcaagcaaattgttgacgcttttaaaaatggcggttcctacgatgatttgttcaagaaagaactcattcaaaaacacttgcctcggttcatcgagggggaagaggagaaacgtattgtagacaactttaataaatttacaacgtactttaccggcttccacgagaatcggaagaatatgtatagcgatgaaaaggaatctacggctatcgcataccgtctgatccacgagaacttaccgcttttccttgacaacatgaaatcatttgccaaaattgccgagagtgaagtcgctgcacggttcactgaaattgagactgcataccgcacctaccttaatgtggagcacattagtgagttgtttactcttgactacttttcgaccgtcttgacccaagaacaaatcgaagtttacaataatatcatcgggggccgtgtggacgatgataacgtgaaaattcagggtcttaacgagtacgtgaatctctacaaccagcaacaaaaggaccgcagcaagcgcttacctctccttaagtcattatataagatgatcttgtccgaccgcatcgcaatctcttggctgcctgaggagttcaaatccgataaagagatgatcgaagcgatcaataacatgcacgacgatctcaaagacattttagccggcgacaacgaggactctctcaaatcccttctgcagcacattggccagtatgatctctcaaagatttacattgccaacaaccctggcttaacggatatttcccaacaaatgttcggctgctacgatgtattcacaaatggcatcaaacaagaattacgtaattccatcaccccttctaagaaggagaaggcggacaacgagatctacgaagagcgcattaataaaatgtttaaaagcgaaaagtcattctccattgcttaccttaactctttaccacatccaaaaacagatgcaccgcagaaaaatgtggaggactattttgcgctgttgggtacatgtaatcagaatgacgaacaacctatcaacctgtttgctcagatcgagatggcccgtctcgtggctagcgatatcttggcgggccgtcacgtcaacctgaaccaatcggagaatgatattaagttgattaaggatcttctcgatgcctacaaggctcttcaacacttcgtgaagccgttactggggagcggggatgaagcggaaaaagataatgagtttgatgctcggttgcgtgcggcttggaacgcactcgacatcgtaaccccactgtataacaaggtccggaattggttaactcggaagccatactcaacagaaaaaattaaattgaatttcgagaacgctcagctgttgggcggctgggaccaaaataaagaacctgactgcactagtgtacttctgcggaaagacgggatgtactatttggcgattatggacaaaaaagcaaaccatgcttttgattgcgattgtttgccatctgatggtgcgtgcttcgaaaagatcgactacaaattgttgccgggggcgaacaaaatgctccctaaggtgttcttctctaagtctcggatcaaggagtttagtccttcagaatctatcattgcggcatacaaaaaagggactcataagaaaggcccaaacttttctctcagtgattgtcatcggcttatcgactttttcaaagcttctatcgacaaacacgaagactggtccaaattccgttttcgtttcagtgacacaaagacctacgaagacatttccggtttttatcgggaagtagaacaacaaggttacatgcttgggtttcgtaaagtatcggaagcctttgttaacaaactggtggacgaaggcaagttgtacttatttcatatttggaacaaagatttcagtaaacattcgaagggcactccaaatctgcataccatttattggaaaatgcttttcgacgagaagaacctcactgatgtcatttataagctgaacgggcaggcagaagtattttatcggaaaaagtctttagacctcaacaagaccacgacacacaaagctcatgctccaattactaataaaaacacgcagaacgccaaaaaaggtagcgtgtttgactacgatattatcaaaaaccggcgttacaccgtagataaattccaatttcacgtcccaatcacattaaactttaaagccacgggtcggaattacattaatgaacatactcaggaggcgatccgtaacaacggtatcgaacacatcattggcatcgaccggggggagcgtcaccttctttacttgtctctcatcgatctcaagggcaatattgtcaagcagatgacactgaacgatatcgtaaacgagtacaacggtcgtacgtatgccaccaactataaggatttgctggcgacccgcgagggtgaacgtaccgatgcgcgccggaattggcaaaagattgaaaacatcaaggagattaaggaaggctacctgagtcaggtagtacacatcctttctaagatgatggtcgattacaaagccattgtcgttcttgaagatctgaacacgggttttatgcgcaaccgtcagaaaattgagcgccaggtttatgaaaagttcgagaagatgttgatcgataagcttaactgttacgtagacaaacagaaagatgcggacgagactggcggcgcgttgcaccctctgcagcttacgaataaattcgaaagtttccgcaagctgggtaaacagtccggttggcttttttatattcctgcttggaatacgtctaagatcgatcctgtgactgggttcgttaacatgctggatactcgctatgaaaatgctgataaagcccgttgtttcttcagcaaatttgactccatccgctacaacgctgataaagattggtttgagtttgctatggactatagtaagttcacagataaagcgaaggatacgtatacctggtggactttatgttcctacgggacgcgcattaaaacctttcgcaacccagctaagaataatctgtgggataacgaggaggtagtgctgaccgacgagttcaaaaaagtatttgcagcggcagggatcgatgtccatgagaacctgaaagaggcaatctgcgcgttaacagataagaaatatctggagccgcttatgcgcttgatgactctgttagttcaaatgcgcaatagtgcaaccaatagcgagaccgattacctgctctcccctgttgccgatgaatcaggtatgttctatgattcgcgtgagggtaaagaaacgcttcctaaggatgcagacgctaatggcgcctacaatattgcccgtaagggcttgtggactatccgtcggattcaagctacgaactgtgaagaaaaggtcaatctggtactttcaaaccgtgaatggcttcagttcgcccagcaaaagccttacctgaatgacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1068 - DNA, 3948 bp, synthetic construct
  misc_feature 1..3948: note = Description of Artificial Sequence: Synthetic polynucleotide
  source 1..3948: mol_type = other DNA
atgggccaccatcatcatcatcatagcagcggcctggtgccgcgcggcagcggtaccatgaaaaatatcttagagcaattcgtcgggctctatccgctctctaagacactgcgcttcgagcttaaaccgcttggcaagacgctcgaacacattgagaaaaaggggttgattgctcaggacgagcaacgggcggaagaatataagttggtcaaggacatcatcgaccgctatcataaagcgtttatccatatgtgtcttaaacacttcaaactcaaaatgtattcagaacagggctatgacagtcttgaggagtaccgcaagctggcttctattagcaagcgcaatgagaaagaggagcaacagtttgacaaggtgaaggaaaacctgcgtaagcaaatcgttgacgcctttaagaatggtggcagctatgatgatttatttaagaaggaactcattcaaaagcacctgccacggttcatcgaaggggaagaagagaaacgtattgttgacaacttcaataaatttacaacctatttcacgggttttcacgagaaccgtaaaaacatgtacagcgacgagaaagaaagtacagctatcgcatatcggctgattcacgagaatttaccactttttctggacaatatgaagtcatttgccaaaatcgcagaatcagaggtagcggcgcggttcaccgaaattgaaacggcctatcggacgtacttgaacgttgaacatatctccgagctcttcactctcgactatttctctacagtgttaactcaagaacaaatcgaggtatacaacaacattattggcgggcgtgtagatgatgacaatgtcaaaattcagggcttgaatgagtacgttaacttatataatcaacagcagaaagaccgttctaaacggcttccattattaaagagcctctacaaaatgatccttagtgaccggatcgcgatcagttggttacctgaggaattcaaaagtgacaaggaaatgatcgaagccattaacaacatgcatgatgatttaaaagatattttggccggtgacaacgaggacagcttaaaatcactcttacaacacatcggccagtatgatctctctaaaatttatattgccaataacccaggcttaactgacatttctcaacaaatgtttggttgttacgacgtcttcaccaatggtatcaaacaggaattgcgtaacagtatcacgcctagtaagaaagaaaaagccgataacgaaatttacgaagaacggatcaacaagatgtttaaatcagaaaagagcttttctattgcctatttaaattcgttaccgcatcctaagactgacgcccctcagaagaacgtagaagattatttcgcactgttgggcacgtgtaatcagaatgatgagcaacctatcaaccttttcgcacaaatcgagatggcgcgtctggttgcatctgatattcttgcgggccggcatgttaacctgaatcagagcgagaatgatatcaaactcatcaaagacctgctcgatgcctacaaagctctccaacactttgtcaaacctttgctcggttcgggtgatgaagcagaaaaggacaatgaattcgacgcacgtcttcgtgccgcctggaacgctctggatattgtgaccccgctgtacaacaaggtgcgcaactggttgacacgtaagccgtactccacggaaaaaatcaaattgaattttgagaatgcgcaacttctgggcgggtgggatcagaacaaagagccagactgtacaagcgtcctccttcggaaggatggcatgtactatttggctatcatggataagaaagcgaatcacgcatttgattgtgattgcttgccatccgacggggcgtgctttgagaaaatcgactataagcttttgccaggtgccaataaaatgctccctaaagttttcttctctaagtctcgcatcaaggagtttagcccgtctgaatctatcattgcggcgtacaaaaagggcacccacaagaaagggccgaacttctcactttcggattgccaccgccttatcgattttttcaaagcgtcgattgataagcatgaggactggagtaaatttcggtttcggttttccgacacaaaaacttatgaagatatctcggggttttatcgtgaggtagagcaacaaggttatatgcttggtttccgcaaagtttccgaagcctttgtgaacaagctggttgacgagggcaaactctatttattccacatctggaacaaggactttagtaagcacagtaagggcacgccaaacctccacactatctactggaaaatgttatttgacgagaagaatctcaccgatgtgatttacaaactcaatgggcaggcggaagtgttttatcgcaaaaaatcgttggatttaaacaagacgaccacgcataaagcacatgccccaatcacgaacaaaaacacacaaaatgccaagaagggttccgtgtttgattatgatatcatcaagaatcgtcgttatacagttgacaaattccagttccacgtgccaattactcttaactttaaggcgacagggcgcaattacattaatgagcatacgcaagaggccattcgtaataatgggatcgagcacatcatcgggatcgaccggggcgagcgccacctgttgtacctctccttaatcgatctgaagggtaatatcgtgaaacaaatgacgttaaacgacatcgtcaatgaatataatggtcgcacgtacgcgacaaactacaaagacctccttgcaactcgtgaaggcgaacgcacagacgctcgccggaactggcagaaaattgagaatatcaaagaaattaaagaggggtatttaagccaggtcgtacatatcctttcgaaaatgatggtggactacaaggctatcgtagttcttgaggacctcaacacgggcttcatgcgtaatcgtcagaagatcgagcgccaggtgtatgaaaaatttgagaaaatgctgatcgacaaattgaattgttatgttgacaaacaaaaggacgccgacgaaacagggggcgcgttgcatcctttacaactcacgaataaatttgagtcgttccgcaaactgggcaaacagtctgggtggcttttttatattccagcgtggaatacgtcgaaaatcgaccctgtcacaggtttcgtcaatatgttagacactcggtatgagaacgctgacaaggcacgttgttttttcagcaaatttgattccattcggtataacgccgataaagattggttcgagtttgcaatggattactcaaagtttaccgacaaagctaaggacacgtatacttggtggacgttatgctcctacggtacgcgtattaagacttttcgtaatccggcaaagaacaacctttgggacaacgaagaagtagtgctcaccgatgaattcaaaaaggtgtttgcagctgctggtattgatgtgcatgagaatcttaaggaggccatttgcgctctgactgacaagaaataccttgagccactcatgcgtctcatgactcttcttgtacaaatgcgcaactcagcaacgaactctgagacggattacttactcagcccggtggccgatgagagcgggatgttctacgactcccgggaaggcaaggagactttaccaaaggacgctgatgccaatggcgcgtataatatcgctcggaaggggttatggacgattcggcggattcaagcgacaaattgtgaagagaaagttaatctggttttaagtaatcgtgaatggctgcaatttgcacaacaaaagccgtatcttaacgatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1069 - DNA, 3948 bp, synthetic construct
  misc_feature 1..3948: note = Description of Artificial Sequence: Synthetic polynucleotide
  source 1..3948: mol_type = other DNA
atgggccaccatcatcatcatcatagcagcggcctggtgccgcgcggcagcggtaccatgaagaatattcttgagcagtttgttggcctctacccactttctaaaaccctgcgtttcgagttaaagcctttggggaaaactctcgaacacatcgagaagaagggcctcatcgcccaagatgagcaacgtgccgaggaatacaagttggttaaagacattatcgaccggtatcacaaggccttcatccatatgtgtctgaagcatttcaaattgaagatgtactccgagcagggttatgacagtcttgaagagtatcgtaaactggcttcgattagcaaacgtaatgaaaaagaggagcaacagttcgataaggtgaaagagaacctgcgcaagcaaattgtggacgcttttaagaatggtggttcctacgatgatttgtttaaaaaagaattaattcagaaacatcttcctcgtttcatcgagggggaggaggagaagcggattgtagataattttaacaaatttactacctacttcacagggttccatgagaaccgtaagaacatgtactcagacgaaaaagagtccacagctatcgcctaccgcttgattcacgaaaatcttccgctcttccttgacaacatgaaatcttttgctaaaatcgctgaatcagaagtagcggcacgtttcacagaaattgaaacggcatatcgcacataccttaacgtcgaacatatttccgagttgttcaccctcgactatttctctacagtcttaacccaagagcaaatcgaggtttacaacaatattattggtggccgtgttgatgatgacaacgttaaaatccaggggttgaatgaatatgtcaacctctacaaccaacaacagaaggatcgttcaaaacgcctgcctttactcaaatctctttataaaatgatcctgagcgatcgcatcgcgatcagctggcttcctgaagaattcaagtctgataaagaaatgatcgaagctatcaataatatgcacgacgatttaaaagacatcttagcaggtgacaatgaggactccctcaaatcgttactgcaacacatcgggcaatatgacttgtcaaaaatctacatcgcaaataatccaggcttaacagacattagccagcagatgtttgggtgttatgacgttttcaccaacgggatcaaacaagagctgcgtaacagtattaccccatcgaagaaggaaaaggctgacaatgagatctacgaagagcgcatcaataagatgtttaagagtgagaaatcgttttctatcgcatatctcaacagcctgcctcaccctaaaaccgacgcaccgcaaaagaacgtggaggattactttgcgctgcttgggacgtgcaatcagaatgatgaacagccgattaatttgttcgcccaaattgagatggcccggttagtcgcatcagacattctggccgggcgtcatgtcaacctgaaccaaagtgagaatgacattaaactgatcaaggacttactcgatgcgtataaagcactgcagcacttcgttaagccgctgcttggctccggggacgaagcagaaaaagataatgagtttgatgcgcgtctccgcgcggcatggaatgcactggacatcgtcactccgttgtacaacaaggtacgtaattggctgacgcgcaagccgtattcgacagaaaaaatcaaactgaactttgagaacgcacaattactcggcggttgggaccagaacaaagagcctgactgtacatcggtcctcctgcggaaagacggtatgtattaccttgccattatggacaagaaagccaaccacgcattcgactgcgactgcttgccgagcgacggtgcttgtttcgaaaagatcgactataagcttttaccaggggctaacaagatgttacctaaagtttttttctccaagtcacggatcaaggagttttcgccttcggaatcaattattgctgcgtacaagaaggggacccataagaaaggtccgaacttcagcctgtcggactgtcatcggcttatcgacttctttaaggcgtctatcgacaagcacgaagactggtccaagtttcgcttccgcttcagtgacactaagacttatgaggacatttcgggcttttaccgcgaagtggagcagcaggggtatatgctcggttttcgcaaagtttccgaagccttcgtcaataagctggtagacgaagggaagctctatttgtttcatatctggaacaaagacttctctaaacattccaagggcacgccaaacttacataccatctactggaagatgctttttgacgaaaaaaatcttacggatgtgatttataagctcaatggtcaagctgaagtcttctatcgtaaaaagtcgctggatctgaataagacgacaacacacaaggctcacgccccgatcacgaacaagaatacacaaaacgcaaagaaagggtccgtgtttgactacgacattatcaagaatcgccggtacacagtcgataagttccaattccacgtaccgattactctcaatttcaaagcgactggtcgcaactacatcaacgagcatacccaggaggccattcgcaacaatggcattgagcacattatcggtattgaccgcggggaacgccatttattatacctttcactcatcgatcttaaaggcaacattgttaagcagatgacccttaatgacattgttaatgagtataatggtcggacttatgctacaaactacaaagacttgttggcgactcgcgaaggggagcgtactgatgcccgtcgtaactggcaaaaaattgaaaatattaaagaaattaaggaaggctatctctcccaagtagtccatatcctctcaaagatgatggtcgactacaaagccattgtggttttagaagatctcaacacgggcttcatgcgtaatcgccaaaagatcgagcgtcaggtatacgagaagttcgagaaaatgcttattgataagcttaattgctacgtagataaacaaaaggatgccgacgagactggtggggcgcttcatccgctccaattgacgaataagtttgagtctttccgtaagttagggaagcagtcagggtggttattttacatcccggcctggaacacgagcaaaattgacccggttacggggtttgtaaatatgctggacacgcgttatgagaatgcggataaagctcgctgcttcttcagcaaatttgactcgattcgctacaatgcggataaagattggttcgaatttgcaatggattacagtaaatttacagacaaggccaaggatacctacacttggtggactctttgcagctacggcacacggattaagacctttcgtaatccagctaagaataatctttgggataacgaggaagtcgtcctgacggatgagttcaagaaagtatttgcggccgccggtatcgacgtgcacgagaacttgaaggaagccatctgtgcactcactgataaaaaataccttgaacctttaatgcgcttaatgacattattggtccagatgcggaatagcgcgaccaattcggaaacagactacctcctctcgcctgtagcagacgaatctggtatgttctacgattctcgcgagggcaaagaaactttgccaaaggacgccgatgcgaacggggcctataatatcgcccgtaaaggtctgtggactatccgtcggatccaggcgacaaattgcgaggaaaaggtcaatttggtgttgtcgaaccgcgagtggcttcagttcgcacagcaaaaaccgtatctgaatgacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1070 - protein, 1271 aa, synthetic construct
  REGION 1..1271: note = Description of Artificial Sequence: Synthetic Cas12a/Cpf1 [Collinsella tanakaei] sequence
MIYRENFKRKKEKIEMNTGFNDFTNLSSVTKTLCNRLIPTEITAKYIKEHGVIEADQERNMMSQELKNILNDFYRSFLNENLVKVHELDFKPLFTEMKKYLETKDNKEALEKAQDDMRKAIHDIFESDDRYKKMFKAEITASILPEFILHNGAYSAEEKEEKMQVVKMFNGFMTSFSAFFTNRENCFSKEKISSSACYRIVDDNAKIHFDNIRIYKNIANKFDYEIEMIEKIEEAAGGADIRNIFSYNFDHFAFNHFVSQDDISFYNYVVGGINKFMNLYCQATKEKLSPYKLRHLHKQILCIEESLYDVPAKFNCDEDVYAAVNDFLNNVRTKSVIERLQMLGKNADSYDLDKIYISKKHFTNISQTLYRDFSVINTALTMSYIDTLPGKGKTKEKKAASMAKNTELISLGEIDKLVDKYNLCPDKAASTRSLIRSISDIVADYKANPLTMNSGIPLAENETEIAVLKEAIEPFMDIFRWCAKFKTDEPVDKDTDFYTELEDINDEIHSIVSLYNRTRNYVTKKPYNTDKFGLYFGTSSFASGWSESKEFTNNAILLAKDDKFYLGVFNAKNKPAKSIIKGHDTIQDGDYKKMVYSLLTGPNKMLPHMFISSSKAVPVYGLTDELLSDYKKGRHLKTSKNFDIDYCHKLIDYFKHCLALYTDWDCFNFKFSDTESYNDIGEFYKEVAEQGYYMNWTYIGSDDIDSLQENGQLYLFQIYNKDFSEKSFGKPSKHTAILRSLFSDENVADPVIKLCGGTEVFFRPKSIKTPVVHKKGSILVSKTYNAQEMDENGNIITVRKCVPDDVYMELYGYYNNSGTPLSAEALKYKDIVDHRTAPYDIIKDRRYTEDEFFINMPVSLNYKAENRRVNVNEMALKYIAQTKDTYIIGIDRGERNLLYVSVIDTDGNIVEQKSLNIINNVDYQAKLKQVEIMRKLARQNWKQGVKIADLKKGYLSQAVHEVAELVIKYNGIVVMEDLNSRFKEKRSKIERGVYQQFETSLIKTLNYLTFKDRKPLEAGGIANGYQLTYIPESLKNVGSQCGCILYVPAAYTSKIDPTTGFVTLFKFKDISSEKAKTDFIGRFDCIRYDAEKDLFAFEFDYDNFETYETCARTKWCAYTYGTRVKKTFRNRKFVSEVIIDITEEIKKTLAATDINWIDSHDIKQEIIDYALSSHIFEMFKLTVQMRNSLCESKDREYDKFVSPILNASGKFFDTDAADKSLPIEADANDAYGIAMKGLYNVLQVKNNWAEGEKFKFSRLSNEDWFNFMQKR

SEQ ID NO: 1071 - DNA, 3816 bp, synthetic construct
  misc_feature 1..3816: note = Description of Artificial Sequence: Synthetic Cas12a/Cpf1 [Collinsella tanakaei] sequence
  source 1..3816: mol_type = other DNA
atgatatacagagagaattttaagcgaaaaaaggagaaaattgagatgaatacaggttttaacgattttacaaatctttcatctgtcacaaaaacattgtgcaacagactgattccaacagaaattacggcaaaatatataaaagaacacggcgttattgaagctgatcaggaaagaaatatgatgagtcaggagcttaagaatattttaaacgacttttacagaagcttcttaaatgagaaccttgtaaaagttcatgaacttgactttaagccgctctttacagaaatgaaaaagtatctggagacaaaggataataaggaagctcttgaaaaagcacaggatgatatgagaaaagccatccatgacatttttgagagcgatgacagatacaaaaagatgttcaaggcagaaattaccgcttccatcctgccagagtttatcctgcacaacggagcctactccgctgaggaaaaagaggagaaaatgcaggttgtcaagatgttcaacggcttcatgacatcattttcagcattctttacgaacagggagaactgcttttcaaaggaaaagatttcatcatctgcatgctacagaattgttgatgacaatgcaaaaatccattttgacaacatccgcatatacaaaaacattgcaaacaaatttgattacgagattgaaatgattgagaagattgaggaagctgctggtggagctgatattagaaatatcttttcgtataacttcgatcattttgccttcaatcattttgtgtcacaggatgatatttctttctacaactatgtcgtaggtggaattaataaattcatgaacctctactgtcaggcgacaaaggaaaaattaagcccatacaagttaagacatcttcacaagcagatactctgcatcgaagaatcactgtatgatgtacctgcaaaattcaattgcgatgaagatgtatatgctgccgttaatgattttcttaacaatgtcagaaccaaatctgttattgaaagactgcagatgctcggtaagaatgctgatagctatgaccttgataagatatacatttcaaagaagcactttacaaatatatcccagacactgtacagggatttcagtgtaatcaatactgctcttaccatgagttacattgacactctcccgggcaaaggcaagaccaaagagaaaaaggctgcatccatggctaaaaacactgaattaataagccttggtgaaattgataaacttgttgataagtataacttatgtccggacaaagctgcaagcacaaggtcgcttataagaagcatttcagatattgtcgctgattacaaagcaaatccgttaactatgaattccggcattccgctcgcagaaaatgagactgaaatcgctgttcttaaggaagcaattgaaccgtttatggacatctttcgctggtgtgcaaagttcaagacagatgagcctgttgacaaggatacggatttttacacagaacttgaggatataaacgatgagatccattctattgtatccttatacaaccgtacaagaaattacgtaaccaagaaaccgtacaacacagacaagttcggattgtattttggcacgtcttcatttgcatcaggttggagtgaaagcaaggaattcaccaacaatgccattcttcttgcaaaagatgacaaattttatcttggagtgttcaatgccaaaaacaaacctgcaaaaagtattatcaaaggacatgatacgatacaggacggtgattacaagaaaatggtctactctcttttaaccggacctaacaagatgctgcctcacatgtttataagctcaagcaaggctgtaccggtttacggactgacagatgagctgctttctgattacaagaaaggcagacatcttaagacgtcaaaaaactttgacatagactactgtcacaaactgattgattactttaagcactgtctcgcactgtatactgactgggactgctttaattttaagttctcagataccgaaagttacaatgacattggtgagttctacaaggaagttgccgaacagggatattacatgaactggacatacattggaagtgatgatattgacagtctgcaggaaaatggccagctgtatctgtttcagatatacaataaagacttttcagaaaagagcttcggaaaaccaagtaagcacactgctattctacgcagtttattcagtgatgaaaatgttgcagatcctgttatcaagttatgcggcggcacggaagtattcttcaggccaaagagcataaaaactcctgtcgttcacaagaaaggttccattcttgtcagtaaaacctacaacgcacaggaaatggatgaaaatggaaacattattaccgtcagaaaatgcgtgcctgatgatgtttacatggagctttacggctactacaacaattcaggaacacctctttcagcagaggcgcttaagtacaaggatattgtagaccaccgcactgccccttatgacatcataaaagaccgcagatatacagaggatgagttctttatcaacatgccggtgtcactaaactacaaggcggaaaacagacgtgtaaatgtaaacgaaatggctcttaagtatattgctcagacaaaggacacttacatcattggaattgaccgtggggagagaaatttgctgtatgtatcagtaattgatactgacggaaacattgttgagcagaaatcccttaacatcattaacaatgtggactatcaggcaaagctcaagcaggttgaaatcatgagaaaactggcaaggcagaactggaaacagggtgtaaaaatagctgacttaaagaaaggctatttgtcacaggcagttcatgaagttgccgagcttgtaataaaatacaatggtattgttgtcatggaagacttaaacagcaggtttaaggaaaagcgttcaaagattgagcgcggggtttaccagcagtttgagacaagcctcattaagactctcaactatctgacattcaaggacagaaaacctctggaagcaggcggaattgccaatggttatcagcttacatacattccggaaagccttaaaaatgtcggaagccagtgtggatgcattctctatgtgccagccgcatatacgtcaaaaattgatccgacaacaggatttgtaaccttattcaagttcaaggatatatcgtctgaaaaagccaagacggactttattggcagatttgactgcatcagatatgatgccgagaaagatttgtttgcatttgagtttgattacgataactttgagacatacgagacctgtgcaagaacaaaatggtgtgcatatacttacggcacaagagttaaaaaaacattccgcaacagaaagttcgttagtgaagtcattattgacataacagaggaaatcaagaaaactcttgctgccacagacataaactggatagatagtcatgacatcaaacaggaaattattgactatgcactctcctctcacatatttgagatgttcaaactcacagtacagatgagaaacagcttatgcgaatcaaaagacagggaatatgacaagtttgtgtcaccgatattaaacgcttcaggaaagttctttgacacggatgctgctgacaagtcacttcctatcgaagcagatgctaacgatgcatatggcattgcaatgaaaggcctatacaatgtgcttcaggtgaagaacaattgggccgagggcgagaaattcaaatttagcagactcagcaatgaagactggttcaatttcatgcagaaaaggtag

SEQ ID NO: 1072 - DNA, 4005 bp, synthetic construct
  misc_feature 1..4005: note = Description of Artificial Sequence: Synthetic polynucleotide
  source 1..4005: mol_type = other DNA
atgggccaccatcatcatcatcatagcagcggcctggtgccgcgcggcagcggtaccatgatctatcgggagaactttaaacgtaagaaggagaagatcgaaatgaacaccggttttaacgatttcaccaacctgtcttcagtaacaaaaaccctgtgtaaccgtttgatccctacggaaatcactgctaaatacattaaagaacacggcgtcatcgaggcagaccaggaacgcaatatgatgtcgcaagagctcaagaatatcttaaacgatttttaccgttcattccttaacgagaacttagtcaaagtccatgaattagattttaaaccgttatttactgagatgaagaaataccttgaaacgaaggataataaggaggccctcgaaaaagcccaggacgatatgcgcaaagcgattcatgacatctttgaatccgacgatcgttataagaagatgttcaaagcggagatcactgcttctattttacctgagttcattttacataacggcgcttatagtgcagaggagaaggaggaaaagatgcaagtggtcaagatgtttaatggcttcatgacttcgttctcggcgttctttactaatcgtgaaaactgcttcagtaaggaaaagatctcgtcctcggcctgctatcgcattgtggacgacaatgctaaaatccatttcgacaatattcggatttataagaatattgcgaacaagtttgattacgagatcgagatgattgaaaagatcgaggaagcggctggtggcgccgacatccgtaacattttcagttacaactttgatcattttgcctttaatcacttcgtgtctcaggatgacatctcattctacaattatgttgtcggtggcatcaataaatttatgaacctgtattgtcaagccaccaaggagaaattatcaccgtataaattacgccatcttcataagcaaattctgtgtatcgaggagtcattatacgatgtaccggctaaattcaactgtgatgaggacgtttatgctgccgtgaatgacttcttaaataatgtgcgcaccaagagcgtaattgaacgcctgcagatgctggggaaaaatgccgacagttacgacctcgacaaaatctatattagtaagaagcattttactaatatcagccaaaccttataccgcgatttctccgttatcaacacggcgttgactatgtcatacatcgatacgcttccggggaaggggaagaccaaggagaagaaggcggctagtatggccaagaatactgagcttatttccttgggggaaattgataagctggtggacaagtacaacctttgccctgacaaagcagctagtacgcggagtctgatccgctcgatttcggatattgttgctgattacaaggccaaccctttgactatgaatagtggcatcccgcttgctgagaatgaaacagagattgccgttttgaaggaagccatcgagccatttatggacatcttccgctggtgtgctaagttcaagactgacgagccggtagataaagatactgatttttatacagaattagaagacatcaatgacgagatccattccatcgtcagcctctacaaccgtacgcgcaactacgtcactaaaaaaccttacaacacagacaaattcgggttatactttggtacctcctcatttgctagtggctggtcggaatccaaggagttcaccaataatgccatcttattagccaaagatgataagttttacctgggggtctttaatgcgaaaaacaaaccagcgaaaagtattatcaaggggcacgacacgattcaggacggcgactacaaaaagatggtctattcactgttaaccggcccaaacaaaatgctgccacatatgtttatcagcagtagtaaagccgttcctgtgtatggtttaactgatgagcttctctcagactataaaaaagggcggcacctgaaaacgtcaaaaaactttgacatcgattactgtcataaactgatcgactactttaagcactgtttagcactttatactgattgggattgttttaatttcaaattttcagatacagagtcgtacaacgatattggcgaattctataaagaagtggcagaacaaggctactacatgaactggacatacatcggttcggatgacatcgacagccttcaggaaaatggccagttatacctcttccaaatttacaataaagacttctccgaaaagagttttgggaagccgtccaaacatacagctatcctgcggagcttgttttcggatgagaacgtggcggatccggttatcaaattatgcgggggtacagaggtattcttccgccctaaatcgattaagacacctgtagtccataagaagggcagtatccttgtttccaaaacttacaatgcccaggagatggatgaaaatggtaacattattaccgttcgcaagtgtgtgccggatgatgtctatatggagctgtatggttactataacaattcgggcacaccactcagtgcagaggcacttaaatacaaagacattgtggaccatcgtactgcgccatacgatattatcaaggatcggcggtatacggaggacgaattttttatcaacatgccagtctccttgaattacaaggcggagaatcggcgtgtcaatgttaacgaaatggcactgaagtatatcgctcagacaaaggatacgtatatcattggtatcgatcgtggtgagcggaatcttctctatgtttccgtgatcgacactgatgggaatatcgtcgagcagaagtcacttaacattattaacaacgtcgactaccaagcgaagctgaagcaagttgaaatcatgcgtaaattagcccggcaaaattggaagcagggggtaaagatcgcagacttgaagaaggggtatctcagccaggcagtccacgaagtggcagaattagtgattaaatacaatggcattgtagttatggaagatctcaacagccggttcaaggaaaagcgttccaagatcgagcgcggggtttaccagcagttcgagacgtcccttatcaagacgttgaattacttaactttcaaggaccggaaacctttagaagccggggggattgcaaatggctatcagctgacctatatcccggagtcgcttaaaaacgtaggttcacagtgtggttgtattttgtacgtacctgctgcatacactagcaagattgatcctactaccgggtttgtcaccctgtttaaatttaaggatatttcttctgagaaggctaagactgatttcatcggtcgctttgactgtatccgttacgacgcggaaaaagaccttttcgcctttgagttcgattatgacaacttcgaaacgtatgaaacttgcgcccgtacaaaatggtgcgcgtatacctacggtactcgtgtaaagaaaacattccggaatcggaagtttgtcagtgaggtgatcatcgacattaccgaagaaatcaagaaaacgttagcagccacagacatcaactggattgacagccacgatattaagcaggagatcattgattacgcactgtcttcccacatttttgagatgtttaaacttactgtgcagatgcgcaattctctttgtgaaagtaaagatcgcgagtatgacaaattcgtttcgccaattttaaacgcgtcaggcaaatttttcgacaccgacgcagccgacaagtctttacctattgaagcggacgcgaacgatgcatacggtattgccatgaagggcctttacaacgtactgcaggttaagaataactgggccgagggtgagaagttcaaattctcccgcctttccaatgaagactggtttaacttcatgcagaagcgcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1073 - DNA, 4005 bp, synthetic construct
  misc_feature 1..4005: note = Description of Artificial Sequence: Synthetic polynucleotide
  source 1..4005: mol_type = other DNA
atgggccaccatcatcatcatcatagcagcggcctggtgccgcgcggcagcggtaccatgatctatcgcgaaaattttaagcggaagaaggaaaagatcgaaatgaataccgggttcaacgatttcactaacctgtcaagcgttactaaaacactgtgtaatcgtttaatcccgactgaaatcacagctaagtatatcaaagagcatggggtaatcgaggctgaccaggaacgtaatatgatgagccaggagctgaaaaacattctcaacgacttttatcgttcatttctcaacgagaatctcgtcaaagtacatgaattggacttcaaaccgttgttcacggaaatgaagaaatacctcgagacaaaggataataaggaagcccttgaaaaagcacaagacgacatgcggaaagccatccatgatatctttgagtcggatgaccgttataagaagatgttcaaagcagagattacagcctctatccttccagagtttatcttgcacaacggcgcgtactccgctgaggaaaaagaagagaagatgcaggtagtcaagatgttcaatgggttcatgactagctttagcgcctttttcacgaaccgggaaaactgtttttccaaagaaaaaatttcgtcatcagcatgctaccggatcgtggatgacaacgcaaagattcacttcgataacatccgtatctacaaaaacattgcgaacaaattcgactacgagatcgagatgatcgagaaaattgaagaagcagccggtggggcagatatccggaatattttctcatacaactttgaccacttcgcattcaatcattttgtttcacaagatgacatctcattctataattatgtggttggggggatcaataaatttatgaacctttactgtcaagccacaaaagagaagttatcaccatacaaactgcggcacctccacaaacagattctttgtattgaggagtctttgtacgatgtgccagcaaagttcaattgcgatgaggacgtttacgcagcggtaaacgacttccttaataacgttcgtacgaagagcgtgatcgagcgcttacagatgctggggaagaatgcagattcttacgatctggataagatctatatctctaaaaaacactttacgaacatctcacagacactctatcgggacttcagtgtgatcaataccgctttgaccatgtcgtatattgataccctcccggggaaagggaagactaaggagaagaaagccgcgagcatggccaaaaacacagaacttatctcactcggtgagatcgataagctggtggacaaatacaatctctgtcctgacaaagccgcaagtacccgctcacttattcgcagtatcagtgatattgtggcggattataaggccaacccacttactatgaacagcggcatcccgttagcagaaaacgagacggaaatcgcagtcctcaaggaagccattgagccgtttatggatattttccggtggtgcgctaagttcaaaactgacgagccagtggataaagatactgatttctacaccgagttggaggacattaacgatgaaattcactctattgtctccctctacaatcggacacgtaactatgtcaccaaaaaaccatataatactgacaagtttggcctgtacttcggtacttcaagttttgcgtcaggctggagtgaaagtaaagaatttactaataacgcaatcttattagccaaagatgacaagttttaccttggtgtatttaatgctaaaaataaaccggctaagagcattatcaaagggcatgataccattcaggacggtgactataaaaaaatggtttactcgctcttaacggggccaaataaaatgctgccacatatgttcattagtagttctaaagccgtcccggtgtatgggctcacggatgagcttcttagtgactataagaagggtcggcacctcaaaacaagcaaaaacttcgatatcgactattgtcacaagcttattgattactttaaacattgcttggcattatataccgactgggattgcttcaacttcaaattctccgataccgaatcgtacaacgatatcggcgaattctacaaagaggtggcggaacaaggttattatatgaactggacctatatcggtagcgatgacattgattcgcttcaagagaatggtcagctttacttgtttcagatctacaataaagactttagtgagaagtcttttggcaagccgagtaaacatacggcgattttacggtcgctcttctcggatgagaatgtggcggatccagttattaagctgtgcggtgggacggaggtgttctttcgtccgaaatcgattaagactccggtagtacataaaaagggtagtattttagtctccaaaacctacaacgctcaagagatggacgaaaacggcaacatcattaccgttcggaagtgtgttcctgatgacgtctacatggagctctatggttactacaataattcgggtactccgttaagtgcggaggcactgaagtacaaggatattgtggatcaccggacggcaccttatgacatcattaaagatcggcggtacaccgaagatgaattcttcatcaatatgccggtgtctttgaactataaggccgaaaaccgtcgcgttaacgtcaacgaaatggcgctgaaatatatcgctcagactaaagatacctacattatcggtattgatcgtggcgagcgcaacttactgtacgtaagtgtaatcgatacagatggcaatattgtggaacagaaatccctgaatattatcaataacgtcgactaccaagcaaaattaaaacaggtcgagattatgcggaagttagctcggcagaactggaaacagggcgtgaaaattgccgaccttaaaaagggctatttgtctcaggctgtacacgaagtagcagagttggtgatcaagtataacggtattgttgttatggaggacttaaacagtcggtttaaggagaaacggtcaaaaattgaacgtggcgtgtaccaacagtttgaaacatcattgattaaaaccttaaattatctcactttcaaggaccggaaacctcttgaagcgggtggtattgcaaatggctatcagctgacttacatcccggaatctcttaaaaacgtaggttcacagtgtggctgtatcttgtacgtgccagctgcttatacctcaaaaatcgaccctaccactggctttgtcacccttttcaaatttaaagatatttcatctgaaaaagctaagaccgacttcattggccgtttcgactgtatccgttatgatgccgagaaggacctctttgcttttgagttcgactacgacaatttcgagacttatgagacttgtgctcgcacgaaatggtgcgcttatacctacgggacccgggtgaaaaaaacttttcgcaatcggaaattcgtatccgaagttattatcgatatcacagaagagatcaagaagactctcgcagctactgacattaattggattgatagtcacgacatcaaacaggagattattgattacgcactgtcttctcacatcttcgagatgttcaagttaaccgtccaaatgcgcaactctctttgtgaatcgaaggatcgtgaatacgataagtttgtctcgccgattttaaatgcgtctggtaaatttttcgacacagatgcagctgacaaatctctcccaattgaggcagacgctaatgacgcctatggtatcgccatgaaaggcttatataacgtactgcaggtaaagaataactgggcagagggtgagaagtttaaattctcacgtttatctaatgaggattggttcaactttatgcaaaaacggggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1074 - DNA, 4005 bp, synthetic construct
  misc_feature 1..4005: note = Description of Artificial Sequence: Synthetic polynucleotide
  source 1..4005: mol_type = other DNA
atgggccaccatcatcatcatcatagcagcggcctggtgccgcgcggcagcggtaccatgatttatcgggagaattttaagcgcaaaaaagagaagatcgagatgaacaccgggtttaacgatttcactaacttgtcatcggtcacgaaaactctgtgtaaccgcctgattccaaccgaaatcactgctaagtacatcaaggagcacggggtaatcgaggccgatcaggagcgcaatatgatgagtcaagaattaaagaacattttgaatgatttctaccggtcatttctcaacgagaacctggttaaggtccatgaactggacttcaagccattgtttacagaaatgaagaagtacctggaaactaaggataataaagaggccttggagaaggctcaggacgatatgcgtaaagcgattcacgatatttttgagtcggacgaccgctataagaaaatgttcaaggccgagatcaccgcgagcatcctgccggaattcatcttacacaacggcgcctatagcgccgaggaaaaagaagaaaaaatgcaggtggtaaagatgttcaatgggttcatgaccagcttttcagcgttttttacgaatcgcgaaaattgcttttccaaagagaagatttcctcttcagcatgctaccgcattgtcgatgataatgctaaaattcattttgacaatatccggatctacaagaatatcgctaacaagttcgattatgaaatcgagatgattgagaaaattgaggaagcagcgggcggggccgacatccggaatattttttcatataacttcgatcattttgcttttaatcacttcgtgtcacaagatgatatttccttctacaactacgtggtcggtggtatcaacaaattcatgaatctttactgtcaagcaaccaaagaaaaactcagcccttataaacttcgtcacctccacaagcagattctttgtatcgaggagtccttatacgatgttccagccaaatttaattgcgatgaggacgtctacgcggcagttaatgatttcctgaataatgtgcgtacaaagtctgtgattgagcgtttacaaatgttaggtaaaaatgcggacagctatgatcttgataagatctacattagtaagaaacattttactaatattagccaaacgctctatcgcgacttcagcgtgattaacacagcgctgaccatgtcatatatcgatacgcttcctgggaaggggaaaacaaaagaaaagaaagcggcgagtatggctaagaatactgaactgatctctcttggcgaaattgataaattagtcgataaatacaacttatgtccagataaagcagcatcaacgcgttcactgatccgtagcatttcagatatcgtggctgattacaaggcaaacccattgactatgaattccggcatcccgctggcagagaatgagacggagattgcagtgctgaaggaggctattgagccttttatggacatttttcgttggtgtgcgaaatttaaaaccgatgagccggttgataaggacacagatttctacaccgaattagaggatatcaatgatgaaattcattctatcgtaagcctttataaccgtacacgtaactacgtgaccaagaaaccttacaacacagacaagttcggcctctatttcgggacgagctcgtttgcatccggctggtctgaatctaaggaattcacaaataatgcaattttgttggcgaaggatgataaattctaccttggtgttttcaatgctaaaaacaaaccggctaaaagcattatcaagggtcatgatacaattcaagacggcgactacaaaaaaatggtgtattcgctgttaacgggccctaacaaaatgcttcctcatatgttcattagttccagtaaggcagtaccggtctacggcctcaccgatgagttgctttcggattacaagaaaggtcgccaccttaagacgtccaaaaatttcgacattgactattgtcacaagttaatcgattatttcaaacattgtttggcgttgtacactgactgggattgtttcaacttcaaattctctgatactgagtcttacaatgacatcggggaattctacaaagaagtagctgaacagggctactatatgaattggacttacatcgggagtgacgatatcgacagccttcaagaaaacggccaattgtatttattccagatttacaacaaggacttcagcgagaaaagtttcggtaaacctagtaaacatacggctatccttcggagtctcttttcagatgaaaacgtggcagacccagttattaagctgtgtggtggcaccgaggtgttcttccgccctaagtcaattaaaaccccagtagtgcataaaaaagggtcaattcttgtgtcgaagacatataacgcacaggaaatggacgagaacggcaacatcatcacagtacggaaatgcgtacctgatgacgtttatatggagctgtacggctattacaataacagcggcaccccgctctcggcggaagctctgaagtacaaagacatcgtggatcaccggacggcgccatacgatatcatcaaagatcgccgttacacggaggacgagttcttcatcaacatgcctgttagtttaaattataaagccgaaaaccggcgtgtaaacgtaaacgagatggcacttaaatatattgcccagactaaggacacctatattatcggcatcgaccgtggcgaacggaatttgctttacgtctccgtaatcgacacagacggcaatattgtcgagcaaaaatcactgaacattatcaataacgttgattaccaggcgaaattgaaacaagttgagattatgcgtaagttagctcggcaaaattggaagcaaggtgtaaagattgccgatctgaagaagggttatctgtcccaggcagtccacgaggtcgccgagctggtcatcaagtataacgggattgtggtgatggaagacctgaatagtcgctttaaagagaagcggtccaaaattgagcgcggtgtgtatcaacaattcgagacgtcgttgattaagacgctgaattacttgacgttcaaagatcgtaaaccattagaagcagggggcatcgccaacggctatcaattgacatacattcctgagtcccttaaaaacgtggggtcccaatgcggttgtatcctttacgtacctgcagcgtatacaagcaaaattgaccctactacaggtttcgtcactttattcaaatttaaggatatctcgtcggagaaagctaaaactgattttatcggtcgctttgactgtatccgttacgatgccgagaaggacctgttcgcctttgaattcgactacgataacttcgagacctacgagacctgcgcccggaccaaatggtgtgcctacacttatgggactcgcgtcaagaagacgttccgtaaccgcaaatttgtaagcgaagttatcatcgacatcactgaagaaatcaaaaaaactctggcggcgaccgacatcaactggattgatagccatgacattaagcaagaaattattgattatgctttgtcctcgcatatttttgaaatgttcaagttaacagtccagatgcggaactcactgtgcgaaagcaaggatcgggagtatgacaagttcgtatcaccgattctcaatgcttctggtaagttttttgacacggacgctgcagataaatcgctcccaattgaagctgatgcgaacgatgcctacggtattgctatgaaagggttgtacaacgtgcttcaagttaagaacaattgggcagaaggcgagaagttcaaattttcccggctcagtaatgaggactggttcaacttcatgcaaaaacgcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1075 - DNA, 4005 bp, synthetic construct
  misc_feature 1..4005: note = Description of Artificial Sequence: Synthetic polynucleotide
  source 1..4005: mol_type = other DNA
atgggccaccatcatcatcatcatagcagcggcctggtgccgcgcggcagcggtaccatgatctatcgggaaaacttcaagcggaaaaaagaaaagatcgaaatgaatactggttttaatgacttcaccaaccttagttctgtaacgaagacgctctgtaaccgtctgattccaactgaaatcactgctaagtacattaaagaacatggcgttattgaggcagaccaagaacggaatatgatgtcacaagagctcaagaatatccttaacgacttttatcgcagtttcctcaatgagaaccttgtcaaggtgcatgaacttgattttaagccgttgtttacagaaatgaaaaaatatctggaaactaaagataataaagaagcactggagaaagcacaggatgacatgcgcaaagccatccacgacatctttgagtctgacgatcgttataagaagatgttcaaggccgaaattacagcgtcgattctgccagaatttattcttcataacggggcttactctgccgaagaaaaggaggagaaaatgcaggtagtgaagatgttcaacggctttatgacgagctttagtgcattctttacgaaccgggagaactgcttctccaaggaaaaaatttcctctagcgcttgctatcgcattgtagacgataatgcgaagatccatttcgataacatccgcatctataaaaatattgccaataagttcgattatgaaattgaaatgattgaaaagattgaagaggccgcaggcggtgctgacatccgcaacattttttcatataattttgaccactttgctttcaaccacttcgtatcgcaagacgacatttctttttacaattatgttgtcggcgggattaacaagtttatgaacctgtattgtcaggcgactaaggagaaactctcaccatataaattgcggcaccttcataaacaaatcctctgtatcgaggagtccctttatgacgttccggctaagtttaattgtgacgaggacgtctatgcagcagtaaacgactttttaaacaatgttcgtaccaaatctgtaattgaacggcttcaaatgctcggtaaaaatgccgattcttatgatttagacaaaatttatattagcaaaaagcattttaccaacatctcccaaactctctatcgtgatttctccgtcattaacacagcattgacgatgtcatacatcgacactctccctggtaagggcaaaaccaaggagaaaaaggctgcaagtatggcaaaaaacaccgagcttatcagtttgggcgaaatcgataaattggtcgataagtacaacttatgcccagataaagccgccagcacacggagcctgatccgttccatctccgacatcgtagcggactataaagcaaaccctttaacgatgaactcaggtattccgttggcagaaaatgagactgagattgccgtgttgaaggaggccatcgagccattcatggacatttttcgctggtgcgcaaagttcaaaaccgatgagccagttgataaagatactgatttttacaccgagctggaagacattaatgacgagattcactctatcgtgagcttatataaccggactcggaattatgtaactaaaaaaccttacaatacagacaagtttgggttatattttgggacgtcctcattcgctagtggctggtcggaatctaaggagtttactaacaatgcgattctcttagctaaagatgataaattttacttaggcgtctttaatgctaagaacaaaccggcaaaatccatcattaaggggcacgacaccattcaagacggcgactacaaaaagatggtctacagtctgttgaccgggcctaataagatgcttccacacatgttcatctcatcatccaaagccgtcccagtgtatggcttgaccgacgaactcctgtcggattataaaaaaggtcgtcatcttaagacttcaaaaaacttcgatatcgactactgccacaaattgattgattacttcaaacattgtttagccttgtacacggattgggactgctttaattttaagttctccgatacagagagctataacgacatcggtgaattctataaggaggtcgcagaacaaggttattatatgaactggacttatatcggttcggacgatatcgactctctccaggaaaatggccaactttaccttttccaaatttacaacaaggacttttccgaaaaatctttcggcaagccatcaaagcatacggcaatccttcgcagtttgttctctgatgagaatgttgccgacccggtcatcaagttgtgtggtggtactgaggttttcttccggccaaagtcgattaagactccagtcgtccacaaaaaaggcagtattctggtcagcaaaacctataatgctcaagaaatggacgagaatggcaacatcatcacagtgcgtaaatgcgtccctgatgatgtatacatggaattgtatggttattacaataactctggtacgcctttgtcagcggaggccttgaaatacaaggacatcgtggaccaccgtactgccccttacgatattattaaagatcggcgttacacggaggacgaatttttcatcaatatgccagtttcactgaactacaaagccgagaaccggcgggttaacgtgaacgagatggcactgaagtatatcgctcagacaaaagacacttatattatcggtattgatcgcggcgagcgtaatcttctttatgtgtctgtgatcgatactgatgggaatattgtggagcagaagagcctcaacatcatcaacaacgttgattatcaggcaaaattaaagcaagtggaaatcatgcgtaaattggcgcggcaaaattggaagcaaggtgtaaagatcgcggacttaaagaaaggttacctctctcaggctgtccacgaggtcgcagaacttgtaatcaaatacaacgggatcgtcgttatggaggacttaaattcccgttttaaagaaaagcggagtaaaatcgagcgcggcgtttatcagcaatttgagacatcattgattaaaacgctcaactaccttacttttaaagaccgtaagccgttagaggcgggtgggattgccaatggctatcaattaacgtatattccggagtccttgaaaaatgtggggtctcagtgcggttgtatcctctatgtacctgccgcttatacgagcaagatcgacccgacgacaggctttgttacattgttcaaattcaaagatatctcgtcagagaaagcaaaaactgattttatcgggcggttcgattgcatccggtacgacgcagagaaggacttgttcgctttcgaattcgactatgacaattttgaaacctacgagacctgcgcgcggacaaagtggtgtgcctatacctatggcacccgcgtcaagaaaacgtttcgtaaccgtaaatttgtaagtgaggtgattatcgacattaccgaggaaattaaaaaaactctcgcggccacggatatcaattggatcgactctcatgacatcaaacaggaaatcattgattacgcattgagcagtcatatctttgaaatgtttaagttgactgttcagatgcgcaattctttatgcgaaagtaaggaccgggagtacgacaaatttgtatcaccgattcttaatgcttccgggaaattcttcgatacagacgccgcggacaagtcattacctatcgaagccgacgcgaacgacgcgtatgggattgctatgaaaggtttgtacaatgttttacaagtgaaaaataattgggcggaaggtgaaaagttcaagtttagtcggctctcaaatgaagattggttcaatttcatgcaaaaacgcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1076 - DNA, 4005 bp, synthetic construct
  misc_feature 1..4005: note = Description of Artificial Sequence: Synthetic polynucleotide
  source 1..4005: mol_type = other DNA
atgggccaccatcatcatcatcatagcagcggcctggtgccgcgcggcagcggtaccatgatttatcgcgaaaacttcaaacgcaaaaaagaaaaaattgaaatgaataccggcttcaatgatttcactaatttgagctccgttacaaaaaccctgtgtaatcgtttgatcccgacggaaatcacagcaaaatacattaaggagcatggggttattgaggccgaccaggagcggaatatgatgtcccaggagctgaagaacattcttaacgatttctaccgctcttttttgaatgagaacttagtgaaagtacatgagttggatttcaagccacttttcacagaaatgaaaaagtatcttgagacgaaggataacaaagaagcactcgaaaaagcgcaggatgatatgcgtaaagcaattcatgatatcttcgaaagtgatgaccgctataagaaaatgttcaaggcggaaatcaccgcatctatcttgccggagtttatcttacacaatggggcgtattcggccgaagagaaggaagaaaaaatgcaggttgttaagatgttcaatggcttcatgacgagcttttctgcgttctttacaaaccgtgagaactgtttcagtaaagaaaagatttcgtcttcagcctgttatcggatcgtagatgacaatgctaaaattcactttgacaacattcgcatctataagaacatcgcaaacaagtttgactatgagatcgagatgattgagaagattgaagaggccgcagggggtgcggacatccgcaatattttttcgtataactttgatcactttgcttttaatcactttgtttcgcaggacgatatttcgttttacaattatgttgtagggggcatcaacaaattcatgaacctgtactgccaagctaccaaagaaaaactttctccatataaattacggcacttacacaaacagatcctgtgcattgaagagtctttatatgatgtcccagcaaaattcaattgtgatgaagatgtctatgccgcagtcaacgatttcctcaacaacgtacggactaagtctgtgatcgagcgtttacagatgcttggcaaaaacgctgactcatatgacttggataaaatttacatttctaagaaacatttcaccaatatctctcagacactgtatcgcgatttcagtgtcattaacactgcacttactatgtcatacattgacacactgccggggaaggggaaaacgaaggaaaaaaaagccgcctctatggcaaagaacacggaactcatctcgctgggggagatcgacaaactcgttgataagtacaacttatgcccagataaagcagctagtacacgcagcttgattcgtagcatttccgacattgtggcagattacaaggcgaatcctttgactatgaattctggtatccctttagccgagaatgagacagaaattgctgtcctcaaggaagcgatcgagccattcatggatatttttcggtggtgcgcaaaattcaaaaccgacgagccagtcgacaaggacacagatttttatactgagcttgaagacatcaatgacgagatccactcaattgtgagcttatacaaccgcacgcgtaattacgtgaccaagaaaccatacaacacagataaatttgggttatacttcggtacatcgtcatttgcatccggttggagtgagagtaaagagtttacaaacaatgctatcctgctcgccaaggatgataagttctacttgggtgttttcaacgccaaaaataagccggccaaaagtatcatcaagggtcacgacacaattcaggatggtgattacaagaagatggtatattccctgctgaccgggccgaacaaaatgcttcctcatatgttcatttccagctcgaaggcagttcctgtatatgggttgacagatgaactcctctctgactataagaaaggtcgtcatctcaagacctctaagaactttgacattgactactgtcataagttgatcgattatttcaaacactgcttggccttatatacggactgggactgctttaattttaaattcagtgatacagaatcctacaacgacattggcgaattctataaggaggtagccgaacagggttattacatgaactggacgtatattggttctgatgatattgattcgcttcaggagaatggccagttgtatttattccagatttacaataaagacttctcagagaaaagttttggcaaaccgagcaagcatactgctattttacggtcgttattctcagatgaaaacgtggctgaccctgtaattaagctctgcgggggtaccgaggtgttcttccgcccaaaaagcatcaagacgccagtcgtacataagaaggggagcatcttagtatcgaagacttacaatgcgcaggagatggacgaaaatggcaacatcatcaccgtccggaaatgcgtgccagacgatgtgtacatggagttatacggttactacaacaattcggggacccctctctcagcagaagcgttaaagtacaaagatattgttgaccatcggaccgcgccatatgatatcattaaagaccgccggtacacggaagatgaattttttattaacatgccagtgtccctcaattataaagcagaaaatcggcgcgtaaacgtgaacgaaatggccttgaagtacattgcccaaacgaaagacacttatattatcgggatcgatcggggggagcgtaatttgttatacgtgagcgtcatcgacacggacggcaatatcgttgagcaaaaaagtcttaatatcattaacaacgtggactatcaggcgaaacttaagcaagtagagattatgcggaaactggcacggcagaattggaagcaaggtgtgaagatcgccgacttgaagaagggttacctttcgcaggccgttcatgaggtcgcagagttagtgatcaaatataacggtatcgtggtaatggaagatcttaatagtcgctttaaggaaaagcggtccaaaattgagcgcggcgtctatcagcagtttgagacatcactcatcaaaaccctcaattacctcacattcaaagatcgcaagccgttagaggccggcggtatcgctaatggctaccagctgacctacatcccggaatcattgaagaatgtgggttctcaatgcggctgcattctttacgtaccagctgcatacacttcaaagattgaccctaccacgggctttgtcacattgtttaaatttaaggatatcagtagtgagaaagcgaaaactgactttatcggtcgttttgattgcatccgctatgatgctgagaaagacttatttgcatttgagtttgactatgacaattttgaaacctacgaaacgtgtgcccgcactaagtggtgtgcctacacgtacggcacacgggttaaaaaaacttttcgcaaccgtaagtttgtcagtgaggtgattattgatatcactgaagaaattaaaaaaacgcttgccgccacggacatcaactggattgactcacacgatatcaaacaagaaatcatcgactatgctctttcgtctcatatctttgagatgtttaagctgaccgttcaaatgcggaattcactgtgtgagtcgaaagatcgtgagtatgataagttcgtctctccaatcttaaatgcttcgggtaaattctttgacaccgacgccgcggataagtctctccctatcgaagccgacgcgaatgacgcttatggcattgcaatgaaagggctctataacgtgcttcaggtaaaaaataattgggctgaaggggaaaagtttaagttctctcgcttatcaaatgaggattggtttaactttatgcaaaaacgtggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1077 - DNA, 4005 bp, synthetic construct
  misc_feature 1..4005: note = Description of Artificial Sequence: Synthetic polynucleotide
  source 1..4005: mol_type = other DNA
atgggccaccatcatcatcatcatagcagcggcctggtgccgcgcggcagcggtaccatgatttaccgtgaaaatttcaagcgtaaaaaggaaaaaatcgaaatgaacacgggctttaacgatttcacaaatctgagtagcgtgactaaaacattgtgtaaccgcttaattcctacagagattaccgccaagtatattaaggagcacggcgtgattgaggctgatcaagagcgtaatatgatgtcccaggaacttaagaatatcctgaacgatttttatcgttcctttctgaatgaaaacctcgtcaaagtccatgagttagattttaaacctcttttcacagaaatgaaaaaatacctggagacaaaagataacaaggaggcgctggaaaaggcacaggatgatatgcgtaaggcgattcatgatattttcgagagtgacgatcgctataaaaagatgttcaaagcggaaattacagcctcaattcttccggagtttatcttacacaatggcgcctattctgcagaagaaaaggaagaaaagatgcaagtagtcaagatgttcaacggcttcatgacttcctttagcgccttttttacaaaccgcgagaattgcttctcaaaggaaaagatcagttcgtccgcatgttatcgcatcgtagacgacaacgccaaaatccactttgataacatccgcatttataaaaacattgctaacaagttcgattatgagattgaaatgatcgaaaaaatcgaagaggcagctgggggtgccgacattcgcaatatcttcagctacaacttcgatcactttgcatttaaccacttcgtctcccaggacgacatctcgttctacaactatgtagttggcggcatcaataaattcatgaacctctactgtcaagctacgaaagaaaaactttccccttataaactccgtcacttacataaacaaatcttatgcattgaggaatctttgtatgatgtgccagctaagttcaattgcgatgaggacgtctacgcagcagtgaatgactttttaaacaacgtccgcaccaagtcggttattgaacgcctccaaatgcttggtaaaaatgcagacagctatgatttagataagatttacatctcaaagaaacatttcactaatatcagccaaacactctaccgggacttttcggtaatcaacaccgctctcaccatgagttatatcgatacattgccaggcaagggtaagacaaaggaaaaaaaggctgcgtccatggcgaaaaatactgaactgatttcattgggcgagatcgataagttagtggacaagtataatttatgccctgataaagcagcatccacccggtcgctcatccgtagtattagcgacatcgtcgcggactataaggcaaaccctcttactatgaattcggggattccacttgccgagaacgagactgaaatcgcggtgctgaaggaggcgattgaacctttcatggatatctttcgttggtgcgctaagttcaagacagatgagcctgtggacaaggatacggatttttacacagagttagaggacatcaacgatgaaattcactcgatcgtctctctttataatcggacacgtaactatgtaacgaaaaagccatacaacacggataaattcgggttgtactttggtacaagctctttcgcaagtgggtggagtgagtcaaaggagttcacgaataatgccatcttgctcgcgaaagacgataagttttacctgggggtttttaatgctaagaacaagcctgctaagtctattattaagggtcatgacactattcaagacggggattacaagaagatggtctactcccttcttacagggccaaacaagatgctcccacatatgttcatttcttcgtccaaagcggtaccggtctacggcctgacggacgaactgctgtcagattataaaaagggtcgtcacctgaagacgagtaagaatttcgatattgattattgtcataagttaatcgattattttaagcactgcctcgccctttacacagactgggattgctttaactttaaattttctgacacagaatcctacaatgacatcggtgaattttacaaagaggttgccgaacaggggtattacatgaattggacttatatcgggtcggacgacattgattcgctccaggagaacggccagctttatttgttccaaatttacaacaaggacttcagcgaaaagtcttttggtaagccgtcgaaacacactgcaattcttcgttcactgttcagtgatgaaaacgttgccgatccagtgattaagctttgtggtggcactgaggtgttctttcggccgaagtcaatcaagacaccagtcgtccacaagaagggctcgattctggtctctaaaacatataacgcacaagaaatggatgaaaatgggaatattatcaccgtgcgtaaatgtgttcctgacgacgtttacatggaactttatgggtactataacaactctgggactccgttgagtgctgaggcgctgaagtataaggacatcgttgatcaccggacggccccgtatgatatcatcaaagatcggcgttacactgaggacgaattttttattaacatgccagtgtctctcaactataaagccgagaaccggcgggttaatgtgaatgaaatggccttaaaatacatcgcccagaccaaggacacatatatcatcggcatcgaccgcggtgaacgtaatctcctctatgtatcagtgattgatacggacggcaacattgttgagcagaaatcgttaaacatcattaataacgtggattaccaagcaaagcttaagcaagtagagatcatgcggaagctggcacgccaaaattggaagcaaggggtcaagatcgcggatctgaagaaaggctacctttcccaagcagtccacgaggtggcggaattagtgatcaagtacaatgggattgtcgttatggaagatcttaatagccgcttcaaggagaagcgtagtaaaatcgagcgtggcgtctatcagcagttcgaaacctctctcattaagactctgaattaccttactttcaaagaccgtaagccacttgaagccggcggcatcgcaaacgggtaccaacttacttacatcccggagtcattaaagaatgtgggctctcaatgtggttgtattttgtacgtacctgcagcatatacgagcaagatcgatccgacaaccggttttgtgaccctgtttaagttcaaggatatttccagcgagaaggcaaaaacagacttcatcgggcgctttgattgtatccggtacgacgccgagaaagatctgtttgcctttgagttcgactatgataactttgagacctacgagacgtgtgcgcgtacgaaatggtgcgcgtacacgtacgggacacgcgtcaaaaaaacattccgcaatcggaaattcgtctctgaggtgatcatcgatattaccgaggaaattaaaaaaacattggcggccactgatattaattggatcgattcccatgatattaaacaggagatcatcgactacgctctgtcgagccatattttcgaaatgtttaaattgaccgtgcagatgcgtaattccctctgcgagagcaaggatcgcgaatacgataagttcgtatctcctattctgaatgccagcgggaaattttttgacactgatgcggctgataaatcgttacctatcgaggcggacgccaacgacgcctacgggattgcaatgaagggcctttacaacgtactgcaagtgaaaaacaattgggcggaaggcgaaaaatttaaattttcccgcttgtcgaacgaggattggttcaattttatgcaaaaacggggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1078 - DNA, 4005 bp, synthetic construct
  misc_feature 1..4005: note = Description of Artificial Sequence: Synthetic polynucleotide
  source 1..4005: mol_type = other DNA
atgggccaccatcatcatcatcatagcagcggcctggtgccgcgcggcagcggtaccatgatctatcgggagaattttaagcgcaagaaggaaaaaattgagatgaatacggggtttaacgatttcactaatctctcatcagttaccaagaccctttgcaaccgtttaattccgactgaaatcaccgccaagtatattaaagaacatggcgtaatcgaagctgaccaggagcgtaacatgatgagtcaggaacttaaaaacattttaaatgacttttatcggagctttttaaacgaaaatttggtaaaggtacacgagctcgactttaaacctctttttaccgaaatgaaaaaatacctggaaaccaaggacaacaaggaagcactcgagaaggcacaagatgatatgcgtaaagcgattcatgatatttttgagtccgacgatcggtacaaaaaaatgttcaaagccgaaattacggccagcattcttccagagtttattcttcataacggggcttactcggcagaagagaaagaagagaagatgcaagtggttaaaatgttcaatgggttcatgacatcatttagtgccttctttactaatcgggagaactgttttagtaaggaaaaaatctcatccagtgcctgttatcggattgttgacgacaacgcaaagatccactttgataatatccggatctacaagaatattgctaataagttcgactatgaaattgaaatgatcgagaaaattgaggaggcggcgggtggggccgatattcgtaatatctttagttacaattttgaccattttgccttcaatcactttgtctctcaggacgatatttctttctataactatgtagtcggcggcattaacaaatttatgaacctgtactgccaagccactaaagaaaagctgagtccatataagttacggcatcttcataagcagatcttatgcattgaggagtccctgtatgatgtaccggccaaattcaattgtgacgaggatgtctatgctgctgtcaacgatttcttgaacaatgtacggacgaaaagcgtaatcgagcggctccaaatgcttggtaaaaacgccgattcctacgatctcgacaagatctacatttccaagaagcacttcacaaatatcagtcaaacgctttatcgcgatttcagtgtaatcaacactgcccttactatgtcttacattgatacccttccaggcaaggggaagacaaaggagaagaaggcagcatctatggcaaagaatacagagttgatctcactcggggaaatcgataagttagtagataagtataatctctgtcctgataaagcggcatcaacccgctcactcattcgttccatctctgatattgtagcggactacaaggcaaaccctttgactatgaactcaggcattccactggctgaaaacgagactgagatcgccgtactcaaggaggcaattgaaccttttatggatatttttcgctggtgtgccaaatttaagacagacgaacctgtggacaaagatacggacttttatacagaactcgaggatatcaacgatgaaatccactccattgttagcctttacaatcgtacgcgtaattacgtgacgaagaagccttataatactgacaagttcggcctttatttcggtacgtcctcgtttgcgtcgggttggtccgagtcgaaagaatttactaacaacgccatcttattagccaaggacgataaattctatctcggggtgtttaatgcaaaaaacaaacctgcaaagtccattatcaaaggccacgatactatccaagacggtgactataagaaaatggtctatagcttattaactgggcctaacaaaatgctcccgcacatgttcatctcctcgagtaaagcagttcctgtgtatgggttaacggatgaactcttgagtgactacaaaaaaggccgtcatttaaaaacttcgaagaactttgacatcgactattgtcacaagcttatcgattattttaagcattgcttagcgctgtacacagattgggattgtttcaactttaagttttcagacaccgagtcctacaacgatatcggcgagttctacaaagaagtggcggagcaaggctactatatgaattggacatacattggttccgatgatatcgactcattacaagagaacggtcaactgtatcttttccagatctacaataaggacttctcggagaagagttttgggaagccttcaaaacatacagcgattcttcggagtctcttttctgacgaaaacgtcgcggatccagtaattaaattgtgtggcggcaccgaagtcttttttcgccctaaatccatcaagacgcctgtagtgcacaaaaagggtagcatcctggtgtcgaaaacctataacgcacaagagatggacgagaacgggaatatcattacagtacggaaatgtgtaccagacgacgtctatatggagttgtatggttattacaacaatagcgggactccactgtcagccgaggctctgaaatataaagatatcgtggatcaccgcacggcaccatacgatattattaaagatcgtcgttacacagaggacgaattctttattaatatgccggtatctctcaattacaaagcagagaatcgtcgtgtcaatgtcaacgaaatggcgctgaagtatattgcccagactaaggacacttacattatcggcattgatcggggggaacggaatctcttatacgttagcgtaattgacaccgacggtaacattgttgaacaaaagagcttgaacattatcaacaacgtagactaccaggctaagctcaaacaagtcgaaattatgcggaaattggcccgccagaactggaagcagggggtgaaaattgctgaccttaaaaaagggtacttatcgcaggctgtccatgaagttgctgagctggtgattaagtacaacggtattgtggtaatggaagacctcaattcccgtttcaaggagaagcgcagtaagattgaacggggtgtttatcaacaattcgaaacttcacttattaaaacattgaactatcttacgtttaaggaccgtaagcctttggaggctggcggcatcgccaatggttaccaacttacatatatcccagaaagcttaaagaatgtcgggagtcaatgtggttgtatcctctatgtgccagcggcatatacaagcaagattgacccgactacaggtttcgtgacactcttcaaattcaaggatatctcttcagagaaagcgaaaacagatttcatcgggcgtttcgattgcatccgctatgatgcggagaaagacctgttcgcattcgagttcgactacgataattttgaaacgtatgagacttgtgctcggactaaatggtgcgcctatacgtatgggacgcgtgtgaagaaaacatttcgtaaccgtaagtttgtttcggaagttattattgacattactgaggagattaaaaagacattggccgcgactgatatcaactggatcgattctcacgacatcaaacaagaaatcattgattacgccctgtcatcacacatttttgagatgttcaagcttacagtgcagatgcggaactcactctgtgaaagcaaggaccgtgaatacgacaaatttgtatcgccgatcttgaatgcatccggtaaattctttgataccgacgcagcagacaaaagtttgccaatcgaggctgatgcgaatgatgcttacggtattgcaatgaaggggttgtacaatgttcttcaagtgaaaaataactgggctgagggggagaaatttaagttttcccgcctttcgaatgaagactggttcaatttcatgcagaaacggggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1079 - DNA, 4005 bp, synthetic construct
  misc_feature 1..4005: note = Description of Artificial Sequence: Synthetic polynucleotide
  source 1..4005: mol_type = other DNA
atgggccaccatcatcatcatcatagcagcggcctggtgccgcgcggcagcggtaccatgatttatcgtgagaactttaaacggaagaaagaaaaaattgagatgaatacaggtttcaatgatttcacgaacctctcatcggtcacgaagaccctgtgcaatcgtctgattcctaccgaaatcacagctaagtacattaaagagcacggggtcatcgaggctgatcaggagcgtaacatgatgtcccaggagttgaaaaatatcttgaacgacttttaccggtcgtttcttaacgaaaacttagttaaagttcacgaactggatttcaaaccgctcttcacagaaatgaaaaagtatttggaaacgaaggacaacaaggaagcgttagaaaaagcgcaagatgacatgcgtaaagcgattcatgacatctttgaatcggatgaccgctataagaagatgttcaaggctgagattacggcgtccattctccctgagtttattcttcataatggtgcctactcggctgaagagaaagaggagaagatgcaagttgttaaaatgttcaatggttttatgacttcattttcggcgtttttcaccaatcgcgaaaattgttttagcaaagagaaaatttccagttccgcatgttatcgtattgttgacgataatgcaaagattcacttcgacaacattcgcatctacaagaatattgctaacaaatttgactacgaaattgagatgatcgaaaaaatcgaggaggcggccgggggggcagatatccgtaatattttttcgtataatttcgatcattttgccttcaatcatttcgtttcgcaggatgatatctctttttacaattatgttgttgggggtatcaataagttcatgaatctttactgccaagcgacaaaagagaagctgtcaccgtataaactccgccatttacacaagcaaattctttgtatcgaagaatcactctacgacgtcccggcaaaatttaattgcgacgaggacgtttatgccgccgttaacgatttcttaaataacgtccgtacgaagtccgttattgagcgtctgcagatgttgggtaaaaacgctgattcatacgaccttgacaagatctacatttcgaagaagcattttactaatatcagtcagactctctatcgtgattttagtgtgatcaataccgccctgacgatgtcttacatcgacactctccctggcaaggggaaaacgaaggaaaagaaagccgcatcgatggcaaagaatacggaattaatttcattaggcgagatcgacaagctcgtggataaatacaacctctgcccggacaaagctgccagcacccgctctctcatccgctcaatctcggacattgtggccgattacaaggctaatcctttgacgatgaacagtgggatcccactggcagagaatgagacagaaatcgccgtactgaaggaagctatcgaaccattcatggatatcttccgttggtgtgctaaattcaaaacggatgagccggtagacaaagatacggacttttacaccgaacttgaggatatcaatgacgagattcatagtattgtcagtctgtataatcgtactcggaattatgtcacgaagaaaccttacaacaccgataaattcggtttgtacttcggtacctcctcattcgcgtccggttggtcggaatcgaaagagtttactaacaacgccattttactcgccaaggatgacaagttttatttaggcgtgtttaatgcgaaaaacaagccagctaagtcaatcattaaaggtcatgataccatccaagacggggactataagaagatggtatattcgttattgactggcccaaacaagatgcttccacatatgttcatttcttcatcgaaagcagttcctgtgtatgggctgaccgacgaattgttatccgattataagaaaggtcgccatctgaaaacatcgaaaaatttcgacattgattactgtcacaaattgatcgattatttcaagcattgcttggcattatatactgactgggactgctttaactttaagttttctgacaccgaatcgtataacgacattggtgagttctacaaggaagtagcagaacaggggtattatatgaactggacttatatcgggtctgatgatattgattcactccaggagaacgggcaactttatctgttccagatttacaacaaagatttcagcgaaaaaagtttcggtaagccatcgaaacacacagccattctccggtcattattcagcgacgaaaatgttgcggacccggttatcaaactgtgtggcggtacggaggtattcttccggccaaaaagtatcaaaacccctgttgttcataaaaaagggagtatccttgtatccaaaacgtataacgctcaggaaatggacgagaatggtaacattatcactgtccgtaagtgtgtgcctgacgacgtatatatggagctttacgggtattataataattctggtacaccgttatctgccgaagctctgaagtacaaggacattgtagatcatcgcacagccccatacgacatcatcaaagatcgccgctacacggaggacgagtttttcattaatatgcctgtcagcttaaattacaaagccgagaaccgccgtgtaaatgtaaatgagatggccttaaaatatattgctcaaacgaaggacacttacattattgggatcgatcggggtgaacgtaatttactctatgtttcagttatcgatacagacggcaatatcgtagagcaaaaatcgctgaacatcatcaacaacgtcgattaccaagccaaacttaagcaagttgaaatcatgcggaagttggcacgtcaaaactggaaacagggggtgaaaattgcggatttaaaaaaggggtatctctcccaagcagtacacgaggttgccgaacttgtgatcaaatataacggcattgtagtaatggaagaccttaactcccgcttcaaggaaaaacgctctaaaattgaacgtggcgtctatcagcagttcgagacatcactcatcaagaccttgaattatctgacatttaaagaccggaaaccacttgaggctggcgggatcgccaatggctatcaattaacatacattcctgagtcacttaaaaatgtaggtagccagtgcggttgcatcctgtacgtcccagccgcgtatacatccaaaattgatccaactacaggcttcgttacgctcttcaaattcaaggatattagcagcgagaaagcaaaaacagattttattggtcgctttgactgtattcgctacgacgcagagaaagacctctttgcttttgagtttgactacgacaattttgaaacgtacgagacttgcgcacgcactaagtggtgtgcttacacctatggcacccgcgtcaagaagacgtttcggaaccggaaatttgttagtgaggtcattatcgatattacggaagagatcaagaagacccttgctgctacggacatcaattggatcgactcgcatgacatcaagcaagaaatcattgattatgccctttcctcgcacattttcgaaatgttcaaacttacggtgcaaatgcgtaattcgctttgtgagtccaaagatcgtgaatacgataaatttgtctctccgatccttaatgccagcggtaagttctttgataccgatgcagcagacaagtccttgcctattgaagccgatgcaaatgatgcgtatgggattgcgatgaaaggcctctataacgtgttgcaagttaagaacaactgggctgagggtgagaagttcaaattcagtcgtctgtccaacgaagactggtttaactttatgcagaaacgcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1080 - DNA, 4005 bp, synthetic construct
  misc_feature 1..4005: note = Description of Artificial Sequence: Synthetic polynucleotide
  source 1..4005: mol_type = other DNA
atgggccaccatcatcatcatcatagcagcggcctggtgccgcgcggcagcggtaccatgatttatcgcgagaactttaagcggaagaaagagaagattgaaatgaacaccggtttcaatgatttcacaaatttgagttcagtcaccaaaacgctctgtaaccgtcttattcctacagaaattaccgctaagtacattaaggagcacggtgtaatcgaagcggatcaggagcggaacatgatgtcgcaagaacttaagaacatccttaatgacttttaccgcagcttccttaatgagaaccttgttaaggtacacgagctcgacttcaaaccattgtttacggaaatgaagaagtatctcgagacaaaggacaacaaagaggctcttgaaaaagcccaggacgatatgcgtaaggcaattcatgacattttcgagtctgatgatcggtataaaaaaatgtttaaagctgaaatcaccgcgtcaatcctcccagagttcattttacacaacggcgcttattcagccgaggagaaagaggaaaaaatgcaggtagtaaaaatgtttaatggttttatgactagtttttccgcgttcttcacaaatcgggaaaattgtttcagcaaagagaagatttcgagcagcgcgtgctaccggattgttgatgacaatgccaaaatccatttcgacaacatccgcatttataagaatattgctaacaaatttgattatgagatcgaaatgatcgaaaagattgaagaagccgccggtggtgctgatattcgtaatattttttcatacaacttcgatcactttgcttttaatcattttgtctcgcaagacgatatctcgttctataattacgtagtaggcgggattaacaagttcatgaatctgtactgtcaggcaaccaaggagaaactgagcccgtataagttgcgccatttgcacaaacagatcttatgtatcgaagaatcactctatgacgtgccagcgaaatttaattgtgatgaagacgtgtatgccgctgtcaacgacttcttgaataatgttcggactaaaagtgtaattgagcgcctccagatgttagggaagaatgccgacagctacgacttggataaaatctatatctcgaaaaagcattttactaatatctcccaaacactttatcgcgacttttcagtaatcaacaccgctctcaccatgtcgtacattgacacgttgcctggcaagggcaaaactaaagagaagaaagctgcgtctatggcgaagaataccgaattaatctccttgggggaaatcgataagctggtagacaagtataatctgtgtccggataaggcagcaagcacccggagccttattcggagtatttcggatatcgtagcagattacaaagctaatccattaactatgaatagcggtattccgttggcagaaaacgagacagaaatcgccgtattgaaggaggccatcgagccatttatggacattttccgctggtgcgcgaaatttaaaacggatgaacctgtcgataaggacactgatttctatacggagctggaggacatcaatgacgaaatccacagcatcgtgtctttatataatcgtacacgcaattacgtaacaaagaagccgtataacacagacaagtttgggttgtacttcggtacgtcatcttttgctagcggctggagtgagagcaaggaattcacaaataatgcaattctccttgctaaagacgacaagttctatttaggtgttttcaacgcgaaaaataaaccggcgaagtctatcatcaagggccacgacaccatccaggacggtgactacaagaagatggtgtacagcttgcttactgggccgaacaaaatgctccctcacatgtttatctcaagctcgaaagcagtcccggtctatggtcttactgacgagttattatcggattataaaaaagggcgccacttgaaaacatctaagaactttgatattgattactgccataaattaattgactacttcaaacactgtctcgccctctatactgactgggattgctttaattttaaattttctgataccgagtcgtacaatgacatcggcgaattctacaaagaagtagcggagcaagggtactatatgaattggacttacattgggtctgatgacattgattctttacaggagaatggtcagctctacctctttcaaatctacaataaagatttttctgaaaaaagcttcgggaaaccaagcaaacacaccgcaattttacgtagtctcttttcggatgaaaacgtggcagatccggtcatcaagctttgtggtgggacggaggtttttttccgtcctaagtcgatcaagactccggtggtgcataaaaaagggtcaattctggtcagcaaaacgtacaacgctcaggaaatggacgagaacggtaatattatcacagttcggaaatgcgttcctgatgacgtttatatggagctctatgggtattataataattctgggacgcctctgtcggccgaagcgttaaagtataaagacattgtcgatcatcgtactgccccgtatgatattatcaaggaccgccggtataccgaggacgaattttttattaacatgcctgtctcattgaactataaagctgaaaaccggcgcgtaaacgtcaatgagatggcgttaaaatacattgcccagacgaaagatacttatatcatcggcatcgaccggggcgagcgtaatctgctgtatgtgtcggttattgatacggacggcaacatcgttgaacagaagtccttgaatatcattaataatgtggactatcaagcaaagctgaaacaagtagaaattatgcggaaacttgcgcgccaaaactggaagcaaggtgtcaagattgcagatctgaagaaagggtatctgagtcaggccgtccatgaggttgcggaacttgtaatcaagtacaatggcattgtggtgatggaagacttaaatagccggtttaaggagaagcgttctaaaatcgagcggggtgtctatcagcaattcgagacttcccttatcaagaccctcaactacctcacattcaaggaccgcaagcctctggaggccggcggtattgcaaacgggtaccaacttacttacatcccagagtcattaaaaaatgtcggttcacagtgcgggtgcattctgtatgtcccggcagcgtacacgagtaaaatcgatcctaccacgggcttcgtgacattgtttaagttcaaagatatctcttcggaaaaagcgaaaacggacttcatcgggcggtttgactgtattcgttacgacgcagaaaaagatctcttcgcgtttgaattcgactatgataactttgagacttacgaaacatgcgcgcgcaccaagtggtgtgcgtatacgtacggcacacgtgtcaaaaaaaccttccgtaaccgtaaattcgtttcggaggtgattattgatattaccgaagagatcaaaaaaactctcgcagcgacagacattaattggatcgactcacatgacattaaacaagagatcattgactacgccctcagctcacacatctttgagatgtttaagcttacggtgcaaatgcgtaattctctttgtgaatcgaaagaccgggaatacgataagttcgtatctccgattcttaatgcttcaggtaaattcttcgacaccgatgcggcggataaaagtttacctatcgaggcggacgctaatgacgcctatgggatcgccatgaaaggtctctacaacgtcttacaggtcaaaaataattgggccgagggggagaaatttaaattttctcgcttgtcgaatgaggactggtttaacttcatgcagaaacgtggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1081 - protein, 1235 aa, synthetic construct
  REGION 1..1235: note = Description of Artificial Sequence: Synthetic Cas12a/Cpf1 [Lachnospiraceae bacterium MC2017] sequence
MTMDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKLLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 1082 - DNA, 3708 bp, synthetic construct
  misc_feature 1..3708: note = Description of Artificial Sequence: Synthetic Cas12a/Cpf1 [Lachnospiraceae bacterium MC2017] sequence
  source 1..3708: mol_type = other DNA
atgactatggattatgggaatggtcagtttgagcggagggcgccactgactaaaacaatcacattaaggctaaaaccaatcggggagacaagagaaaccatacgtgagcagaagctccttgaacaggatgcagctttcagaaagctcgtcgaaacagtaacccctatagtggatgattgtatccgaaagattgcagacaatgcactttgtcattttggtacagaatatgatttttcgtgtttaggtaatgcgatttcgaaaaatgattcaaaagcgataaaaaaagaaacagaaaaagttgagaagttactagcaaaagtattaaccgagaatcttccggatggtcttcgtaaagttaatgacataaattctgcggcgtttattcaggatacgttgacatcgtttgttcaggatgatgcagataaaagggttcttattcaggagttgaaaggcaaaactgtcctcatgcagagatttttaacgactcggataactgctcttacggtatggctgccggatcgggtttttgagaattttaacattttcattgagaatgcagagaaaatgcgtattttgttagattctccattaaacgaaaagatcatgaagttcgatcctgatgcagaacagtatgcatcgttggagttttatggacagtgcctttcacaaaaggatatagacagctacaatcttatcatttcaggaatttatgctgacgatgaggtaaagaatccgggaattaacgagatagttaaagagtataatcagcagataagaggggacaaggacgagtcacccctacctaagctcaagaaactccataaacagatactcatgccggttgaaaaggcattctttgtcagggtactgagtaatgattctgacgcaagaagtattcttgagaagatactcaaggatacagaaatgctgccatcgaagattatagaagccatgaaagaggctgatgcgggggatattgcagtatatggaagtcggttacatgagctttctcatgttatttacggggatcatggtaaactctcgcagattatttatgataaagagtcaaagcgtatctctgaattgatggaaactttaagtccaaaagagagaaaagaaagcaaaaagagactggaagggcttgaagagcatattcgtaaaagtacgtacacttttgacgaattaaatagatatgcagaaaagaatgttatggctgcatatattgctgctgtggaagaatcatgcgcggaaatcatgaggaaggaaaaggatcttcgcacactgcttagtaaagaagatgtaaagataagaggaaatcgacacaatacacttatcgtcaagaactattttaacgcatggacggtatttagaaatttgatccgaattttgcgccgaaagagcgaagcagagatagatagtgatttttatgatgttttggatgattcagttgaagttctgagtcttacatacaaaggtgagaacctttgcaggagctatattacaaaaaaaatcggatcagatttaaaaccggagatagcgacatatggatcggcattgcgtcctaattcccggtggtggagtcctggtgagaagtttaatgtcaagtttcacacgatcgtcagaagagacggaagactgtattattttattttaccaaagggcgcgaagcctgtagagttggaggacatggatggtgatattgagtgtcttcagatgcgtaagattccaaatccgacaatcttcctcccgaaactcgtgtttaaggatcctgaagcttttttccgggataatccagaggcggatgagtttgtttttttatcgggaatgaaggctccggttactatcacgcgagaaacatatgaggcatatagatataagctatacactgttggcaagttaagggacggagaggtaagcgaagaggagtacaaaagggctcttttacaagtgttgaccgcatataaggagttcctagagaacaggatgatatatgcagatcttaattttggatttaaggatttagaagaatataaagattcatccgaattcattaaacaggttgaaacgcataatactttcatgtgttgggcaaaggttagcagttctcagcttgatgatcttgtgaaatcaggaaatggattattatttgaaatctggagcgagagactggaaagttattacaaatacggcaatgaaaaggttctgagaggatatgagggagtgcttctttcaattctaaaagatgagaatcttgtcagcatgaggacacttctcaatagccgcccaatgcttgtttatagaccgaaggaatcgtcgaagcccatggtcgtccacagggacggttcaagagttgtagatcgcttcgataaggatggaaagtatatcccgcctgaggttcacgatgaattgtaccgcttttttaataatttgctcataaaagaaaaacttggggaaaaagcacggaagatcttagataataaaaaggtgaaagttaaggttcttgagtcagagcgtgtgaaatggtcgaagttttacgatgagcaatttgctgttacgttttcggttaagaagaatgctgattgcctagatactactaaagatctgaatgcagaggttatggaacagtacagcgaaagtaaccgacttatcctgatccggaacacaacagatattctttattatcttgttttggataaaaatgggaaagtattaaagcagagaagtcttaacattattaacgatggtgcaagagacgttgactggaaggagagatttaggcaggtaacaaaggatcggaatgaaggttataacgaatgggactattcacgaacgtcaaatgacctgaaagaggtttatctaaactatgccttgaaagagatagcggaagctgtcattgaatataatgcgatccttatcatcgagaagatgagcaatgctttcaaggataaatattcttttcttgatgacgtgacatttaaagggttcgaaacaaagctgcttgcaaagttatccgatctgcatttcaggggaatcaaggatggggagccgtgttctttcacaaaccctttgcaactctgtcagaacgattcaaacaagatattgcaggatggtgtcatttttatggttccgaattcaatgacacgttctcttgatcctgatacgggattcatttttgcaatcaacgatcacaacatccgtaccaaaaaggcaaagcttaatttcctttctaaatttgatcagctaaaggtttcgtctgagggttgtcttataatgaagtatagcggagattctttaccaactcataatacagataatagagtgtggaattgctgctgcaatcatccaattaccaactacgatcgtgaaacaaaaaaagtcgaatttatcgaagagcctgtcgaagagctttcaagggttttagaggagaatggaattgagacggatactgagttaaataagctgaatgaaagggaaaatgttccgggaaaagtcgttgacgcaatttattcgcttgtacttaattatcttcgaggaactgttagtggagttgcgggacaacgtgcggtgtactattcaccagtaacaggaaagaaatatgacatatcttttatacaggcgatgaatcttaatcgtaaatgtgattactacagaatcggctcaaaggaaagaggcgaatggactgattttgtagctcagttgattaattga

SEQ ID NO: 1083 - DNA, 3897 bp, synthetic construct
  misc_feature 1..3897: note = Description of Artificial Sequence: Synthetic polynucleotide
  source 1..3897: mol_type = other DNA
atgggccaccatcatcatcatcatagcagcggcctggtgccgcgcggcagcggtaccatgacgatggactacgggaacggccagttcgaacgccgggcacctttaacaaaaactatcactttacgcctcaagccgatcggggaaacgcgggagactattcgtgagcaaaaactcctggaacaggatgcagccttccgcaaactcgtcgaaaccgtgaccccaatcgtggatgattgtattcggaaaatcgctgataacgccctttgtcacttcggtactgaatatgattttagttgtcttggtaatgccatttccaagaatgattccaaggctattaaaaaggaaacggaaaaggtagaaaagctgctcgcgaaggtcttaactgaaaatctccctgatgggcttcgtaaggtcaatgacattaattcggcggcatttattcaagatactctgactagtttcgtacaggatgatgccgataaacgggtcttaattcaggaattaaaggggaagacagtactgatgcagcggtttttaaccacccgtattactgccctgacggtttggctcccggatcgcgtgttcgaaaacttcaatatttttatcgagaatgcggaaaagatgcgtatcttgctggactcgcctttaaacgaaaaaatcatgaagttcgatccagatgctgagcagtacgcatcgttggaattctatggtcaatgcctgagtcaaaaggatattgattcctacaatttaatcatctctggcatttacgcggacgacgaggttaaaaatcctgggattaacgaaattgtcaaggagtacaatcaacagatccgtggggacaaagatgagtccccgttgccaaaacttaaaaagcttcataagcaaattctcatgccggtggaaaaagcctttttcgtgcgggtcctcagcaacgactcagatgcccgcagtattctcgagaagatcttaaaagacacagaaatgttgccgtctaagattatcgaagcgatgaaagaagctgatgctggtgacatcgccgtatatggctctcggctgcatgagctctctcacgttatctacggggaccatggcaagctctcgcagatcatttatgataaagagagcaagcgcatcagtgaacttatggaaactttaagtccaaaggagcggaaagaatctaaaaaacggctcgaaggccttgaagagcatatccgcaagtccacttacacctttgatgagttgaaccgttacgcagagaaaaatgtcatggcggcgtatatcgcggcagttgaggaatcgtgtgccgaaattatgcggaaggagaaagatctccgtacactcttgagtaaggaagacgtgaaaatccgtggtaatcgtcataacacacttattgttaaaaactatttcaacgcctggacagtgttccgcaacttaatccgcattttacgtcgcaaatcagaggcggagatcgactcagacttctatgacgtgcttgatgatagcgttgaagtattgtccctgacctataagggggagaatttatgtcgctcgtacatcacgaaaaagattggctccgatttaaaaccggagatcgcaacctatggcagcgcgctccggccaaactctcggtggtggagcccaggcgaaaagtttaatgtaaaattccatacaattgtgcggcgcgacggccgtctctattactttattttaccgaagggcgcaaaacctgtagaattggaggacatggatggcgacatcgagtgtctccaaatgcgcaaaatcccgaatccaacgatcttcttaccaaaattagtcttcaaagatcctgaagccttcttccgtgacaacccagaggctgatgaattcgtttttttgtcaggcatgaaagccccggtcactattacacgtgaaacttacgaggcctatcgctacaagttatatacagtgggcaaattacgtgatggtgaggtgtctgaagaggagtataaacgtgctctccttcaggtcttaactgcttataaagagttcttagagaaccggatgatttatgcggacctcaattttggctttaaagacttagaggaatataaagactcctcagagttcattaagcaagtcgaaacccacaatacgtttatgtgctgggcgaaagtaagtagcagtcaattggacgatctggttaagtcaggtaacggtctgctttttgaaatttggtctgaacgtctggagtcctactacaagtatgggaatgaaaaagttttacgtgggtatgagggcgttctgctctcgattctcaaggatgagaatctcgtatctatgcgcactttgctgaactcacgtccgatgctcgtctatcgcccgaaagaaagttccaagccgatggttgtacaccgtgatgggtctcgggtggtggatcggttcgataaggatgggaagtacatcccgcctgaggtccatgatgagctctaccgtttctttaataatcttctcatcaaggagaaacttggcgaaaaggcccgtaaaatcttagataacaaaaaagtcaaggtcaaggtgttggagtccgagcgtgtcaaatggtctaagttctatgacgaacagttcgctgtaactttttcggtcaaaaaaaatgccgactgtcttgacactacgaaggatttgaacgccgaggtaatggaacaatactccgaaagtaatcgtctcattctcatccggaacacaactgatatcctctattacctggttcttgacaaaaatggtaaggttctgaagcagcggagcttgaacattattaacgacggtgcgcgtgatgtcgattggaaagagcgtttccgtcaagtgaccaaagaccggaacgaagggtacaatgaatgggactatagtcgtactagcaacgacctgaaggaggtatacttgaattacgcgctgaaggaaatcgcggaggctgtaattgagtataacgcgatcctcattattgagaaaatgtccaatgcctttaaggacaaatattctttcttagacgatgtaactttcaaggggttcgaaactaagctcttagccaagctgagcgatctccactttcggggcattaaggatggcgaaccatgctcttttaccaatccgctccagttatgccagaatgattctaataaaattctgcaagacggggtgattttcatggtgcctaacagtatgacccgttcattggatccggatactggttttattttcgcaatcaatgatcataatatccgcactaaaaaagcaaagttgaactttctctccaaattcgaccaactgaaggtctcatctgaagggtgtttaatcatgaagtacagcggggatagcctcccgacccataacaccgataaccgggtttggaactgttgttgcaatcaccctattactaattacgaccgtgagacaaagaaagtcgagtttatcgaagagcctgtagaggagttgtctcgcgtgcttgaggagaatgggatcgaaacagacaccgaactcaacaaattgaacgaacgggaaaatgtgccggggaaagttgtagatgcaatctactctcttgttttgaactacttacgtgggaccgtgtccggggttgccgggcaacgggccgtctattattcgccggtgacagggaagaagtatgacatcagtttcatccaggccatgaatttaaatcggaaatgcgattattatcggatcgggagcaaagaacggggtgaatggacggatttcgtggcacaacttattaacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1084 - DNA, 3897 bp, synthetic construct
  misc_feature 1..3897: note = Description of Artificial Sequence: Synthetic polynucleotide
  source 1..3897: mol_type = other DNA
atgggccaccatcatcatcatcatagcagcggcctggtgccgcgcggcagcggtaccatgactatggactacggcaatggccagttcgaacgtcgcgctccgttaaccaagaccattactctccggctgaagccaatcggtgagacacgggagaccattcgggaacagaagttattggagcaagatgccgcatttcgcaaactcgttgagactgtgacacctattgtagacgattgcattcggaagattgcagacaatgcgctgtgtcattttggcactgaatatgattttagttgcttgggtaacgcgattagtaagaatgattctaaagcaatcaaaaaggagacagaaaaggtagaaaaactgctcgccaaagttttgacggagaacctcccggacgggctccggaaggtaaatgatatcaactctgcagcattcatccaagacacccttacgtctttcgttcaagatgacgctgacaaacgggttctcatccaggagttaaaagggaaaactgtcttaatgcagcgttttctcactactcgtatcactgcgctgactgtatggttgcctgaccgggtgtttgaaaacttcaacattttcattgagaacgcggaaaagatgcgtattctgcttgattcgccactcaacgagaagatcatgaagttcgacccggatgctgaacagtatgcctctttagagttctatgggcagtgcctttcgcaaaaagatattgattcatacaacttaattatctcgggcatttacgcagacgatgaggttaaaaacccggggatcaatgaaattgttaaggaatataaccagcagatccgtggggataaagatgagtcaccgttaccgaaattgaaaaagctgcacaagcaaatcctcatgccagtcgagaaagccttcttcgtacgggtccttagcaatgattcagatgcacgctcaatcctggaaaaaattctgaaagacactgagatgctgccaagtaaaatcattgaagctatgaaagaagccgacgcaggtgatatcgccgtgtacggcagtcggcttcatgaattgtctcatgtgatctacggcgatcatggtaagctttcgcaaattatctatgacaaggagtctaagcggatttcggaactcatggagactttatctccgaaagaacggaaggagtcgaaaaaacggctggagggtcttgaagaacacattcgcaaaagtacgtacacgttcgatgagttaaatcgttatgcagaaaaaaacgtaatggccgcgtacatcgcggcagtagaggagtcttgcgcggaaattatgcgtaaagaaaaggacttacggacgctcctctcgaaggaagatgtaaaaattcgtgggaatcgccacaatacgcttattgtaaaaaactactttaatgcgtggaccgtcttccgcaatctgatccggatccttcggcggaagtcggaggccgaaatcgatagcgatttctacgacgtattagacgattctgtggaagttctcagcttgacctacaaaggcgagaacctgtgtcgttcttatattactaaaaaaatcgggtctgatcttaaacctgagattgcaacgtatggctccgcattacgcccaaactctcggtggtggtcaccaggcgaaaaatttaacgtgaagtttcatactattgtccggcgcgacggtcgtctttactattttatcctgccgaaaggggcgaagcctgtcgagttagaggacatggatggtgatatcgagtgtctgcaaatgcgcaagattccgaatccgaccattttcctccctaaacttgtgtttaaggacccggaagcttttttccgggataacccagaggcggatgagttcgttttccttagcggcatgaaggcaccagttacgatcacacgtgaaacgtatgaagcataccgctacaaactgtatacagttggtaaattacgcgacggggaagtcagtgaggaagaatacaaacgtgctttactccaggtattaaccgcgtataaggagtttttggagaaccggatgatctatgccgatcttaattttgggttcaaggacttggaagaatataaggactcctctgaattcatcaagcaggttgaaacccataacacattcatgtgctgggccaaggtaagttcaagccagttggatgacctggtaaaatccggtaacggtcttctgtttgaaatctggtcagagcggttggaaagctattataaatatggcaacgagaaggttcttcgtggctacgagggcgttttactgtcgatcttgaaagatgagaacctggtaagtatgcgtacccttttgaattcacgtcctatgcttgtgtaccggccaaaggagagtagtaaacctatggttgtccaccgcgacgggtcacgtgtcgtagaccgcttcgacaaggacgggaaatacatcccgcctgaagtgcatgacgagctgtatcgcttcttcaacaatctgttaatcaaagagaagctcggtgagaaggcgcgtaagatcttggacaacaaaaaagtgaaagtcaaagtactggaatcggagcgcgttaaatggtccaagttctatgacgagcaattcgcggtaacatttagcgttaagaaaaacgccgattgcttggatacaacgaaggatcttaatgctgaggtgatggagcaatacagcgaaagcaatcgcttaatccttattcggaatactactgatattctttactaccttgtattggacaaaaatggtaaggttctgaaacaacgttccctgaacatcattaacgatggtgctcgggatgttgactggaaagaacgcttccgccaggtcacaaaagaccgcaacgagggttataatgagtgggactattctcgtacctctaatgatcttaaagaggtgtacttgaattatgcgttaaaagaaatcgccgaggctgtgattgagtataatgccattttaattatcgagaaaatgtcaaatgccttcaaagataaatacagcttcctggacgatgtcacatttaaagggttcgaaactaaactgcttgcgaagttatcggatctccatttccggggcattaaagacggggagccgtgtagctttacgaacccactccaattatgtcagaacgactcaaacaagattttacaagatggggtaatttttatggttcctaatagtatgacccgtagcctcgacccagatactggtttcattttcgctatcaacgaccacaacatccgtacgaaaaaagcaaaacttaacttcctttcgaagttcgatcagttgaaggtctcgtcggaaggttgcctgatcatgaagtattctggggacagtcttccaacacacaacaccgataatcgggtatggaactgctgctgtaatcacccaatcacaaactacgatcgcgaaaccaaaaaggttgagtttattgaagagccagtggaggaattgtctcgcgtattagaagagaacgggatcgaaactgataccgagcttaacaaactgaacgagcgggagaacgtacctgggaaagtcgttgacgcaatctatagcttggtcttaaattatttgcgtggcacagtctccggtgtagccggccaacgcgctgtatattacagcccagtgacggggaagaagtacgatatttcattcattcaagcgatgaatcttaatcgcaagtgtgactattaccggattgggtcgaaagagcggggcgaatggaccgacttcgttgctcaattaatcaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1085 - DNA, 3897 bp, synthetic construct
  misc_feature 1..3897: note = Description of Artificial Sequence: Synthetic polynucleotide
  source 1..3897: mol_type = other DNA
atgggccaccatcatcatcatcatagcagcggcctggtgccgcgcggcagcggtaccatgaccatggactacggcaatgggcaattcgaacggcgggcaccgctcaccaagactattacacttcgcttaaaacctatcggcgaaacccgcgagacgattcgtgagcagaaactgctcgagcaggatgctgcattccggaaattggtggagacggtcacccctatcgtggacgattgcatccgcaagatcgccgataatgctctgtgtcacttcgggaccgaatacgacttttcatgcctgggtaacgctatttccaaaaatgattctaaggccatcaagaaagaaactgagaaagtggagaagctgcttgcaaaggtcctcactgaaaatcttccggatggcctgcgtaaggtgaacgatatcaactctgctgcgtttatccaagataccctgacatccttcgtgcaggacgatgcagataagcgggtattaatccaggagcttaaagggaaaactgtactgatgcagcgtttcttaacaacacggatcaccgctctgacggtctggctccctgatcgtgtttttgagaactttaatatctttatcgagaatgcggagaagatgcgtattctccttgactctccgcttaatgagaagatcatgaaatttgatccggacgcggaacaatacgcgtctcttgaattctacgggcagtgcttatcgcaaaaagacattgactcctacaatttaatcattagtggtatttatgctgacgatgaagttaagaatccaggcattaacgaaatcgttaaagagtacaatcagcagatccgtggcgataaggatgaaagcccgcttccgaaattgaaaaaactgcataagcaaatcctcatgccagtagagaaagctttctttgtccgtgttctgtcaaatgattctgatgcccgttcgatcttggaaaaaatccttaaggatacagagatgctgcctagtaagattattgaagccatgaaagaggcagatgctggcgatatcgctgtctatggctctcgtctccatgaactcagtcacgttatttacggggaccatggtaagctctcgcagatcatttatgacaaagagtcaaaacgcatttccgagttgatggagactttgtccccaaaggagcggaaggagagcaaaaagcgtctcgaggggttggaggagcatattcgtaagagtacgtatacgtttgatgagcttaatcgctatgcagaaaagaatgttatggcggcgtatatcgccgctgttgaggaatcttgtgctgagatcatgcgcaaggaaaaagatttacggactttgctgtccaaggaagatgtaaaaattcgcggcaatcgccacaacacattaatcgtcaagaactatttcaatgcatggacggtttttcgcaaccttattcgtattctccgtcgcaaatctgaggccgaaatcgactctgatttttacgatgtcctcgacgattcagttgaagttctgtcccttacttacaaaggcgaaaacttatgtcgcagttatatcacaaaaaaaatcggctccgatctgaaaccggaaattgccacatatggttccgccctgcggccgaactcacggtggtggtcgcctggggaaaagttcaatgtaaagttccacactatcgtccgccgggacggccgtctctactattttatcctgcctaaaggtgcaaaaccggttgaactcgaagatatggacggtgatattgaatgtttacaaatgcgtaagatcccaaatccaacgatcttccttcctaaattggtgttcaaggatcctgaggccttctttcgcgacaatccggaggcggacgaatttgtatttctgtcggggatgaaagcgccagtaacgatcactcgtgaaacgtatgaggcctatcgctacaagttgtatacggtaggcaagcttcgcgatggtgaggtatcagaagaggagtataaacgtgcgttgttgcaggtcttaacggcttataaggaatttctggagaatcgtatgatttacgctgatctcaactttggtttcaaggatctggaggagtataaagactcttcggaattcatcaaacaagtggaaactcacaatacgttcatgtgttgggccaaggtgtcgtcgtcccagcttgacgacctggtcaagtctggcaatggtttgttgttcgaaatctggtcggaacgtcttgaaagttactacaagtatggcaacgaaaaggtcttgcgtggttacgaaggtgtcttactcagcatcctgaaggacgaaaatctggtatcgatgcgcacactcttgaattcacgcccgatgttagtgtaccgtcctaaggagtcatctaaacctatggtcgtccaccgcgatggtagccgtgttgtagaccgcttcgacaaagacggcaaatatattccaccggaagtgcacgacgaactctatcgcttcttcaataatttgttgatcaaagaaaaattgggtgagaaggcccgtaagattctcgataacaaaaaggtaaaagtcaaagtcttggagagtgaacgcgttaaatggtcaaaattttatgacgaacagttcgctgtaaccttctccgttaaaaagaacgccgattgcctcgacacgactaaggatctcaacgctgaggttatggaacagtactcggaatctaatcgtcttatcctgattcgtaacacaaccgatatcttatactaccttgttttggacaagaatggtaaagttctgaagcaacgtagtttaaacatcatcaatgatggggcacgggacgttgattggaaagagcgttttcgtcaggtcacgaaagatcgtaatgaggggtataatgagtgggactactcgcgtacgagtaacgatctcaaagaagtctacttaaattacgcgcttaaagagatcgcggaggcggttattgagtataacgccatcctgatcattgagaaaatgtcaaatgcttttaaagacaaatacagtttccttgatgacgtcacctttaaaggttttgagaccaaattgcttgcaaaattgagtgatcttcatttccgggggattaaggatggtgaaccatgtagtttcactaacccgctgcaattatgtcaaaacgatagtaacaagatcctgcaagacggcgtgatcttcatggtaccgaactctatgacccggtcgctcgatcctgatactggctttattttcgctatcaatgatcacaacattcgcactaaaaaggccaaattaaactttttgtccaagtttgatcaattaaaggtctccagcgaagggtgccttatcatgaagtatagcggtgacagtctccctacgcacaataccgacaatcgggtatggaattgctgctgtaaccacccgattactaactatgaccgtgagaccaaaaaagtcgaattcatcgaagaaccagtcgaggaattgtctcgggttttggaagagaacggtattgagaccgacaccgaattgaacaaacttaacgaacgcgaaaacgtccctggcaaggtagtggatgccatctactccctcgtattaaattacttacggggtacagtctctggtgtcgctggccaacgcgctgtctactatagtccggtaacgggcaaaaagtatgatatctcgttcattcaggccatgaatctgaatcgtaaatgcgactattatcgtattgggagcaaggaacgcggggaatggactgacttcgtcgcacaactgatcaacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1086 - DNA, 3897 bp, synthetic construct
  misc_feature 1..3897: note = Description of Artificial Sequence: Synthetic polynucleotide
  source 1..3897: mol_type = other DNA
atgggccaccatcatcatcatcatagcagcggcctggtgccgcgcggcagcggtaccatgaccatggactacggcaatgggcaattcgagcggcgcgccccattgacgaaaaccattaccctccgtctcaaaccaattggcgaaactcgcgaaacaatccgtgagcagaaacttctggagcaagacgctgctttccggaagttagtggaaacagtcacaccgatcgttgacgattgcattcgcaagatcgctgacaatgccctttgccactttggtaccgagtatgatttctcatgccttggcaacgccattagcaaaaatgactccaaagcaatcaagaaagagaccgagaaagttgagaaactgttagcgaaggttctcaccgagaatcttcctgacggtcttcgtaaagtcaacgatatcaacagcgctgccttcatccaggatacgttaacttctttcgttcaggatgatgcagacaagcgggtgttgattcaagaactgaaaggcaagaccgttctgatgcaacgcttcctcaccactcgtatcacggctttgaccgtgtggctcccggatcgcgtatttgagaacttcaacatcttcatcgagaacgccgagaaaatgcgtatcctgttagatagtccgctgaacgagaaaattatgaagtttgaccctgacgcggaacaatatgcctcgctggaattctacgggcagtgtttgagccaaaaggatatcgactcctacaacttgatcatcagtggtatttacgctgatgacgaggtcaagaacccaggtatcaacgaaatcgttaaagagtacaatcaacaaattcggggggataaggatgagagtccgctccctaagcttaaaaagttgcataaacaaatccttatgccggtcgaaaaagcttttttcgtacgggttttaagtaatgatagtgacgctcgctcaattttagagaaaatcttaaaggacaccgagatgttgccatcaaaaatcattgaagccatgaaagaggcggacgcaggcgatatcgcagtatatggctcccgtttacacgaactctcgcacgttatctacggcgaccacggcaaactcagtcagattatctacgacaaggaatcaaaacggatttctgagctgatggagactctttctcctaaagagcgcaaagaatctaagaaacgcctcgagggcttggaagagcatattcgcaagtccacctatacgtttgacgagcttaaccgttacgccgaaaagaacgtgatggccgcgtatattgctgcggtcgaggaaagctgcgcagaaatcatgcgtaaggagaaggatttgcggactctcctctcgaaggaagatgtcaaaatccgcggtaaccgccacaacacactgatcgtcaaaaactattttaacgcttggacagtttttcgcaacctgatccgtatcttacgtcgtaaatctgaagctgagattgactcagatttctatgacgtcttggacgatagcgttgaagtcctctcattaacctataagggcgaaaatctttgtcgtagttacattaccaagaagatcgggtccgatttgaagccggaaattgcaacgtatggttctgcgctgcggccaaattcgcggtggtggtctcctggcgagaagtttaatgtgaagttccatactattgtacggcgtgatggccggctgtactactttattttgccgaaaggggcaaagccagtagaactcgaagatatggacggcgacattgaatgtttacagatgcgtaaaattcctaacccgacaattttccttccaaagttagtctttaaagatcctgaagcctttttccgtgataacccagaggcggacgaatttgtctttttatccggcatgaaggccccagtaacgattacgcgggaaacgtacgaggcttatcgttataagctctacactgtaggtaaattacgggatggtgaggtatctgaagaggagtacaagcgtgcattacttcaggttttaacggcgtacaaggagtttctcgaaaaccggatgatctacgccgatcttaattttgggttcaaggacttggaagagtataaagattctagcgagtttattaaacaggtagagacccataatacattcatgtgctgggccaaagtttcgtcaagtcaattagacgacctcgtaaagtccgggaacggtctcttatttgaaatttggtcggaacgtcttgagtcttactataagtatggcaatgagaaagtactccggggctatgagggtgttctgttaagtattctcaaagacgagaatttagtatctatgcggactttacttaactcccgcccgatgcttgtttatcgtcctaaggagagcagtaagcctatggtggtacaccgtgatggttctcgggtggttgaccgttttgacaaagatggcaaatatattccgccagaggtacatgatgagctttaccgcttttttaacaatctcctcatcaaagagaaattaggcgagaaagctcgtaaaatcctcgacaacaaaaaggttaaagtcaaagtcttggagtccgagcgcgtgaaatggtccaagttttacgacgagcagttcgctgtgacctttagcgtcaagaagaatgccgattgcctcgataccaccaaggatctgaacgcagaggtgatggaacaatactccgagagcaaccgcctcatcttaattcgtaacactactgatatcctctactacctggtcttagacaagaatggtaaggtcctgaaacagcgtagcttaaacatcattaacgatggggcccgggacgtcgactggaaggagcgtttccgccaggttaccaaggatcgcaacgaaggttacaatgagtgggattactcacgcacttcgaacgacttaaaagaggtataccttaattatgctcttaaggaaattgctgaagcggtcatcgagtataacgcaattcttatcatcgaaaagatgtctaatgcctttaaagacaaatatagcttcttggatgacgtcacatttaagggctttgagacaaaacttctcgcgaagcttagcgacctgcattttcgggggattaaggacggcgagccgtgttcattcaccaatccgctgcaattgtgtcagaacgattcaaacaaaattctccaggatggggttatttttatggtacctaatagtatgacacgtagcttggaccctgacactggctttatcttcgctattaacgaccataacatccgcacgaagaaggctaaattaaacttcctctctaaatttgaccagttaaaggtctcctcagagggctgtttaatcatgaagtattccggtgacagtcttccgacccacaatactgataaccgtgtgtggaactgttgttgtaatcaccctatcaccaactacgaccgggagacgaagaaagttgaatttattgaggaaccagtagaagaattgagtcgcgtattagaggagaacgggattgaaactgacacagagctcaacaagctgaatgagcgggagaacgttccgggcaaagtagttgatgctatctatagtttggtactcaattatctgcgcggtacagtgtccggtgtggccggccagcgtgcagtgtattactccccagttacgggtaagaagtatgacatttcttttattcaggctatgaaccttaatcggaaatgtgactactaccggatcgggagcaaggaacggggggagtggacggatttcgtcgcccagctgatcaacggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1087 - DNA, 3897 bp, synthetic construct
  misc_feature 1..3897: note = Description of Artificial Sequence: Synthetic polynucleotide
  source 1..3897: mol_type = other DNA
atgggccaccatcatcatcatcatagcagcggcctggtgccgcgcggcagcggtaccatgacaatggactatgggaacggccagtttgagcgccgggcacctctcactaaaacaattactctgcgcttaaaaccaatcggggaaacacgggaaacaattcgtgagcaaaaactcctcgaacaggatgctgcgtttcgtaagctggtcgagaccgtaacacctatcgtagacgattgtattcggaaaattgcagacaatgctctgtgtcacttcgggaccgaatatgatttttcgtgcctggggaacgcaatctccaaaaacgattccaaggcgatcaagaaggaaacggagaaagtcgagaaattactggctaaagttcttacagagaacctcccagatggtttgcgcaaggtgaacgatattaacagtgcggcattcatccaagacacactgacatcttttgtccaggatgacgctgataaacgcgttctgattcaagaattgaaagggaagactgtcttgatgcaacgctttttgacgactcgcatcacagcacttacagtgtggcttcctgaccgtgttttcgaaaattttaacatctttatcgaaaatgcggaaaaaatgcgtatcttgttggacagtcctctgaatgagaagattatgaaatttgatcctgacgcggaacagtatgcctcactggaattctacgggcaatgtctgtcccaaaaggatattgattcgtacaatcttattatctctgggatctacgccgacgatgaagtgaagaacccgggtatcaatgaaattgtaaaagaatacaatcagcagatccgcggggataaggatgagtctccgctcccgaaattaaaaaagcttcacaagcaaatccttatgccagtagaaaaagcatttttcgtccgggtgttgtcaaatgatagcgacgcccggagcattcttgagaaaatcttaaaagatacggagatgttaccttcgaaaatcatcgaagcaatgaaagaggcagacgctggcgacatcgcagtatacggcagccggttacatgagctctcgcacgtgatttatggggatcacggtaagctcagtcagatcatctatgacaaagaatcaaaacggatctctgagttaatggaaacgctttcccctaaggaacgcaaagagagcaaaaagcgtttggagggcctggaagagcatattcggaagtcgacctacacctttgacgagctcaaccgttatgccgagaagaacgtcatggcagcatatatcgctgccgttgaagaatcatgcgccgagattatgcgtaaggagaaggatctgcgtacgctgttaagtaaagaagacgtaaaaattcgtgggaaccgtcataatacgctcattgtgaaaaactattttaatgcatggactgtctttcggaatctcatccgcattctgcgtcgcaaatcggaagcagaaatcgatagtgatttttacgatgtgctggatgactccgtggaagttctcagtttgacgtacaaaggcgagaacttgtgccgctcctacattacaaagaaaattggctccgatctcaagccggaaatcgccacttatggttcggctctgcgtcctaattcgcggtggtggagtcctggcgaaaaatttaatgtaaaatttcacaccattgtccggcgggacggccggttatactattttatccttccgaagggcgccaagccagttgagttagaagatatggacggtgacattgaatgcctgcaaatgcggaaaatcccgaatcctacaatcttcctgccaaaactggtgttcaaagatccagaggccttttttcgcgacaatccggaggcggatgagttcgtgtttctcagtggtatgaaagccccagttactatcacgcgggagacgtacgaagcgtaccggtataaactctatacggtggggaaattgcgggacggcgaagtttcagaagaggaatacaaacgcgcccttcttcaagtacttacggcatataaagagttcttggagaaccgcatgatttacgccgatctgaacttcgggtttaaagacctggaggagtacaaggatagcagtgagttcatcaaacaagttgaaactcacaataccttcatgtgctgggcgaaagtcagctcgagccagcttgacgatctcgtcaaaagtggcaacgggttattatttgaaatctggtcagagcggttggagtcgtattacaagtacggcaacgagaaagtgcttcgcggttacgagggggtactcctgtcgatcctcaaagacgagaatttggtctccatgcgtactcttctgaactctcgtccgatgctggtctaccgtccaaaggaatctagtaagccaatggtagtccatcgtgacgggtcacgcgtcgtagatcggtttgacaaagatggtaaatatattcctcctgaagtccacgatgagctgtatcgtttcttcaataacctcctgatcaaggagaagttaggggaaaaagcacgcaaaatcttagacaataaaaaagtgaaagtgaaggtcctcgagtcggagcgggttaaatggagtaagttttatgacgagcagttcgcagtaacgttcagcgtcaagaagaacgccgattgtctcgatactactaaggatctgaatgccgaggtgatggaacagtacagtgagtcgaatcgtcttattttaattcgtaacacgaccgacatcctgtattatttggtcttggataagaacggcaaggtattaaagcaacgttcactcaacattatcaatgatggggctcgcgacgtggactggaaggaacggttccgtcaagtaactaaggatcgcaatgaggggtacaacgagtgggactattctcggacctcgaacgacctgaaagaggtttaccttaactacgccctcaaagagattgcggaggcggtaattgaatacaacgcgatcctcattattgagaagatgagcaacgcatttaaagacaagtatagtttcttggacgacgttaccttcaaaggctttgagacgaagctcctggcgaagcttagtgacctgcattttcggggtattaaggacggggaaccatgtagcttcactaaccctctgcaactctgtcagaatgatagcaacaaaattttacaggatggtgtgatttttatggtacctaatagcatgacgcgttcccttgacccagatacaggctttatctttgcaatcaatgatcataacatccgcacgaaaaaggcgaaacttaactttctgtcaaaattcgaccagctcaaagttagtagtgaggggtgcttgatcatgaaatatagtggcgattccctgcctacacataatacagacaaccgggtctggaactgctgctgcaaccatccgatcacaaactatgatcgcgaaacaaagaaggtcgaatttatcgaggaacctgtagaggaattatctcgggtcttagaggagaatgggatcgaaacagacaccgagttgaataagcttaacgagcgtgaaaatgtgccaggcaaagtggttgatgccatctattcccttgtgttgaactatttacgggggacagtgtcaggtgtggcgggtcagcgcgctgtgtattactctccagtcaccgggaagaaatatgacattagcttcattcaagcgatgaacctcaatcgcaagtgcgactattatcgcattggtagtaaagaacgtggcgagtggactgacttcgttgctcagttaattaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1088 - DNA, 3897 bp, synthetic construct
  misc_feature 1..3897: note = Description of Artificial Sequence: Synthetic polynucleotide
  source 1..3897: mol_type = other DNA
atgggccaccatcatcatcatcatagcagcggcctggtgccgcgcggcagcggtaccatgaccatggactacggcaacggccagttcgaacggcgtgcaccgttgactaaaactatcacacttcggttgaagccgatcggtgagacgcgggaaacgatccgcgaacaaaagctgctcgagcaagacgcggcatttcgcaagcttgtggagacagttaccccgattgtggacgactgtattcgtaaaattgctgataatgcgttatgtcactttgggacagagtatgacttctcctgcctggggaatgctatctcaaagaatgattccaaagctatcaagaaagaaacggagaaagttgaaaaattgctggccaaagtgttgacggagaacctgcctgatggtttacgcaaagttaatgatatcaactccgcagcatttattcaagataccctgacatcgtttgtgcaagatgatgccgacaagcgcgttctgattcaggaacttaagggcaagacggtactgatgcagcgtttcctcaccacacggatcacagccttgactgtgtggcttcctgatcgcgttttcgagaacttcaatatcttcattgagaatgcggagaagatgcgcatcctgctcgacagcccgctcaatgaaaagatcatgaaatttgacccagacgcggagcagtatgcatcactggagttttatggccaatgtctcagtcaaaaagacatcgattcgtataatctgatcatttcaggtatttacgcggacgacgaagtcaaaaaccctggcattaacgagatcgtcaaggaatacaatcagcaaattcgtggggataaagatgaatcgcctttacctaagctcaagaaattacataaacaaattctcatgccagtagaaaaggcctttttcgtgcgcgtactgagtaatgactccgatgctcgttccatccttgagaaaattctgaaagacaccgaaatgctgccgagcaagatcattgaggctatgaaagaggcagatgcgggtgatattgccgtctacggctcgcgtttgcatgagttatcgcacgtgatctatggggaccacgggaaattgtcccaaattatttacgacaaggaatctaaacggatctccgaattaatggaaacactttccccaaaagagcgtaaagaaagcaaaaagcggttggaagggctggaggaacacattcgcaagagtacgtatacgttcgacgagctcaatcgttatgcggagaagaacgttatggctgcttacatcgcagccgtagaggaatcatgtgcagaaatcatgcgtaaagaaaaagatctgcgcacgcttttaagcaaagaggatgttaaaattcgcggcaaccgtcacaatactctgattgtcaaaaattattttaacgcttggactgtatttcgtaatcttatccgtatcctgcgtcgcaaatctgaggccgaaattgatagcgacttctatgacgtgctggatgacagtgtagaagttttatcactcacttataagggcgaaaacctttgccggagctatatcaccaaaaagatcgggagtgaccttaagccagaaatcgcgacgtacggctcagctctgcgtccgaacagccgctggtggtcaccgggggagaaattcaatgtgaaattccacacaattgtgcgtcgggacggccggttgtattactttatcctgccgaagggtgcaaaaccggttgaactcgaagacatggatggtgacattgagtgcttgcagatgcgtaaaatcccaaaccctacgatttttcttccgaagttagtgttcaaggaccctgaagccttcttccgtgataacccagaggcggacgaattcgtcttcctgtctgggatgaaagccccggtaacgattacgcgtgaaacttatgaggcttatcgctataagttatacactgtaggtaaattgcgcgatggcgaagtttcggaagaggaatataaacgtgctttattgcaggtgttaacagcttataaagagttcctcgagaaccggatgatttatgctgatcttaacttcggttttaaagacttggaggagtacaaagacagctcggaatttattaagcaagttgaaacccacaatacgttcatgtgttgggctaaggttagtagctcacagctggacgatctggtcaaatcgggcaacggcttactctttgaaatctggtcggagcggttagaaagctattataaatacggcaatgagaaggttctgcgcgggtatgagggcgtcctcttatccattctcaaagatgagaatttggtgtcaatgcggaccttattgaactctcggcctatgttggtttatcggcctaaagaatccagcaagcctatggtagttcaccgggatgggtcacgtgttgtagaccggttcgacaaggacggtaaatatattcctcctgaagtccacgacgaactgtaccgtttttttaataatcttcttatcaaagaaaagcttggtgagaaggcccgtaaaattttagataataagaaggttaaggtgaaagttctggagtctgagcgggtaaagtggtccaaattctacgatgaacagttcgccgttacattctcggttaagaaaaatgcggattgtttagacacgactaaggatttgaacgctgaagttatggagcagtactcagagtctaatcgcttaattctgatccgcaacaccactgatatcttatactaccttgttctggacaagaatgggaaggttctcaaacaacgctctctcaacatcattaacgacggcgcgcgtgacgtagactggaaagagcgttttcgtcaagtgaccaaagaccgcaacgagggctataatgaatgggactattcacgcacatctaatgaccttaaggaggtgtatctgaattacgcactgaaggaaatcgcggaggcagtaattgagtacaatgcaatccttattatcgaaaaaatgagcaacgcttttaaggacaagtattcatttctggatgacgtcacgtttaaggggtttgaaacgaaactcctggcaaaactgtcagacctgcatttccgcggtattaaagatggcgagccgtgcagtttcacaaacccgttacaattgtgtcagaacgactcgaataagattcttcaagatggggtaattttcatggtgccgaattcgatgacccggagcttggaccctgacacaggttttatctttgcaattaacgatcataacattcggacaaaaaaggcaaagttaaatttccttagtaaatttgaccagctcaaagtaagttcggaaggctgcttgattatgaagtattcaggggactcattacctacgcataacaccgataaccgtgtttggaattgctgctgtaatcatccaatcacgaactacgatcgggagacaaaaaaagtggaatttattgaagaaccagttgaagagctctcgcgtgtactcgaggaaaacggcattgagaccgacaccgaactgaataagctcaatgaacgcgagaatgtcccagggaaggtagtcgacgccatttactcattagtacttaactatttacggggtacggtctcaggcgttgctggccagcgggcagtatattactctccagtgaccgggaagaaatacgatatttcatttattcaagccatgaacttgaatcgtaaatgcgactactatcggatcgggtctaaggagcgcggcgaatggacggacttcgtcgcacaacttattaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1089 - DNA, 3897 bp, synthetic construct
  misc_feature 1..3897: note = Description of Artificial Sequence: Synthetic polynucleotide
  source 1..3897: mol_type = other DNA
atgggccaccatcatcatcatcatagcagcggcctggtgccgcgcggcagcggtaccatgacaatggactatgggaatggtcagtttgagcgtcgggccccattgacaaagacgatcacgctccgtttgaaaccgatcggtgaaacgcgcgagaccatccgggagcaaaaattgttggaacaagacgcagcgttccgtaagttggttgagaccgtgacgccaatcgttgatgactgcattcgtaaaatcgctgataatgccttgtgtcacttcggcaccgagtacgatttcagttgtctcggtaatgcgatcagcaagaacgattcgaaagccatcaaaaaggagactgagaaggtagagaaattattggccaaagtacttactgagaatttacctgatggcctccgtaaagttaacgacattaatagcgctgccttcattcaggatacattaaccagtttcgtccaggacgacgccgataagcgcgtgcttattcaggagcttaaaggtaagacggtattgatgcaacgtttccttacgacacgtatcaccgcgttgacggtgtggttaccagatcgcgtcttcgagaattttaatatttttattgaaaacgccgaaaaaatgcgtatcctcttggacagcccacttaacgaaaagattatgaaatttgaccctgatgccgaacagtacgcatcgctggagttctacggtcaatgtcttagccagaaggacatcgattcatacaatcttattatctctggcatttacgctgacgacgaagtaaagaaccctggtattaatgagattgtaaaggagtataaccagcaaatccggggggacaaagatgaatctccactcccaaagctcaaaaagcttcataagcagattctcatgccggttgagaaagcattttttgtgcgtgtcttgagtaatgattcagatgctcgtagtattttagagaagattcttaaggatactgagatgctcccatcaaaaattattgaggcgatgaaagaagcggatgctggggatattgcagtgtatgggtcccggctccatgagttatctcatgtcatttacggtgaccacggtaagctgtcccaaattatctacgataaggaaagcaagcgtatctcagaattaatggaaaccctctcgcctaaggagcgcaaggagtccaaaaagcggcttgaagggcttgaggaacacattcggaagtccacttacacttttgacgagcttaatcgttatgctgagaaaaatgtgatggctgcgtacatcgcagcagtggaggaatcctgtgccgaaatcatgcgcaaagagaaagatctgcgcaccctgcttagcaaagaagatgttaagatccggggtaatcgccataacacccttattgtaaagaactacttcaatgcatggacagtcttccgcaatcttatccggatcctccgtcgtaagtcagaggccgaaatcgactcagacttctatgatgtgctcgatgatagcgtggaagtattatcactgacttacaagggggagaatctgtgtcgctcttatatcacaaagaagatcgggtctgacctcaaaccagaaatcgccacttatgggagtgccctccggcctaactcgcgttggtggtccccaggggaaaagttcaacgtgaaatttcatacgattgtgcggcgcgacggccgtctttattattttattttgcctaagggtgcaaaacctgtggaattggaggatatggatggtgatattgaatgccttcagatgcggaaaattcctaaccctacaatctttctcccaaagcttgtgtttaaagatccggaggccttttttcgtgacaatcctgaggccgacgaattcgtgttcctgtcaggtatgaaagcccctgtgacaatcacccgggaaacctatgaagcgtatcgctataaactttacaccgtcggcaagctgcgtgacggcgaggtttcagaggaagagtacaaacgggctctgttgcaggtgctcacggcttacaaagagtttttagagaaccgcatgatttatgctgatctcaacttcgggtttaaagatttggaggaatataaggatagtagcgagttcatcaagcaagtggaaacgcataacacgttcatgtgctgggcaaaggttagtagctctcagttggacgatctggttaagtcaggcaatggcctgttattcgaaatttggtccgaacgtctggagtcatactacaagtacggtaacgagaaagtattacgtggctatgaaggtgtattactctctatcttaaaagacgagaaccttgtttcgatgcgcactttgttaaatagccggccgatgcttgtgtatcgcccgaaggagagtagcaaacctatggtagtccaccgcgatggttcacgggtggtcgatcgtttcgacaaggatgggaagtacattccacctgaggtccatgatgagctttatcgcttctttaataacttgctgatcaaagaaaagcttggtgaaaaagcacggaagatccttgacaacaaaaaagttaaagtaaaggtgctcgagtccgagcgtgtaaagtggagcaagttttacgatgaacaatttgccgtgactttctccgttaagaaaaacgcagattgtcttgacactacgaaagacctcaatgctgaggtaatggagcagtactcagaatcgaatcgtttaatccttattcgcaataccacggatattctgtattatcttgttctggacaagaatggtaaagtgttaaaacagcgcagcttgaacatcattaacgatggggcccgggacgtcgattggaaggagcgcttccggcaagtgactaaagaccgcaatgaagggtataatgagtgggactattcgcggacttcgaatgatcttaaggaggtttatttgaactatgctcttaaggagatcgcagaggccgtgatcgagtataacgcaatccttattattgagaagatgtccaacgcttttaaggacaaatactcctttctcgatgacgtaacctttaaggggtttgaaacaaagctcttagcgaagttgtcagaccttcactttcggggcattaaagacggtgagccttgcagttttactaatccactccaattatgtcaaaacgactctaataaaattttacaggacggtgttattttcatggtgccaaactctatgacgcgcagcttagacccagataccggttttatcttcgcaattaatgatcacaatatccgcacaaagaaagcgaaactgaattttctctcaaaattcgatcagctgaaggtctcgtccgaggggtgccttatcatgaaatacagcggtgactctctgcctactcataacacagacaatcgggtttggaattgttgctgtaatcatccgatcactaattacgatcgtgagactaaaaaagtggaatttatcgaagaacctgtggaggagctgtctcgtgtacttgaagagaacggcattgagactgacacagagctgaataagttaaatgagcgtgaaaacgttcctggcaaagttgttgatgctatctacagcttggtattaaactacctccggggcaccgttagtggtgttgctgggcagcgtgcagtttattacagccctgttaccggcaagaaatacgacatttcctttatccaagcgatgaacctcaaccggaaatgcgattattatcggattggtagcaaagaacgtggtgaatggaccgatttcgtcgcgcagttgattaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1090 - DNA, 3897 bp, synthetic construct
  misc_feature 1..3897: note = Description of Artificial Sequence: Synthetic polynucleotide
  source 1..3897: mol_type = other DNA
atgggccaccatcatcatcatcatagcagcggcctggtgccgcgcggcagcggtaccatgactatggactacgggaatggccaatttgaacgtcgggccccactgacgaaaacaatcacgctccgcctgaagcctattggtgagacccgggaaacgattcgtgagcagaagttattagagcaagatgccgcgttccgtaagctggtcgagactgtgacccctattgttgacgactgtatccggaaaattgcagataacgcactttgtcacttcgggacggaatacgatttctcctgcttgggtaacgcgatcagcaagaatgattcgaaagcaattaagaaggagacggagaaggtggagaaactcttggcaaaggtacttacagagaacttacctgatggtttacgtaaagtaaatgatatcaattctgcggcgttcattcaagatacgttaacctccttcgttcaagatgatgcagataaacgtgtcttgatccaggagctgaaaggtaaaaccgtgctgatgcaacgctttttaacgactcggattactgccttgaccgtctggcttccggaccgcgtgttcgaaaactttaatattttcatcgagaatgccgaaaagatgcgtattttacttgacagtcctctgaatgagaagatcatgaaattcgatccggatgcggaacagtacgcgtcacttgaattttacggccagtgcctgagtcagaaagacattgatagctacaatctcattatcagtggtatttacgctgacgacgaagttaagaatccaggcattaatgagattgtaaaggagtacaaccagcaaatccgcggggacaaagacgagtctcctttaccaaaactgaagaagctccacaagcaaatcctgatgccagtagaaaaagcattcttcgttcgggtcttgtctaacgactccgacgcgcggagcatcctcgagaagatcttaaaagatacggaaatgcttccaagtaaaattatcgaggcaatgaaagaggcagacgctggggatatcgctgtatacgggagccgtttgcacgagcttagtcatgtgatttacggcgatcacgggaaattaagtcaaattatctacgacaaagaaagtaaacggatctccgaattgatggaaactctgagcccaaaggagcgtaaggagtccaaaaaacgtcttgaaggcttggaagaacacattcgtaagtcgacttatacattcgatgaactgaatcgttatgcggagaaaaacgtcatggctgcttacattgctgcagtagaagagtcctgcgctgaaattatgcgtaaagagaaggacctgcggacgttactctcaaaggaagacgtcaagattcggggcaaccgccataacacgctgattgtcaagaattattttaatgcatggacagtgttccggaatctcatccgtattttgcggcggaaatctgaagctgagattgactcggatttctacgatgtactggacgatagcgttgaagtattgtcgcttacgtataagggtgaaaacctctgccgcagttatatcaccaagaaaattggcagcgatcttaagccagaaattgctacgtacggttcagcgctgcgtccgaactcacgttggtggagtccaggtgagaaatttaatgtgaaatttcacacgattgtccgccgtgatgggcgcttatactatttcattctgccgaaaggggcaaaaccagtagagctcgaggacatggacggcgatatcgagtgtttacaaatgcggaaaattcctaacccgacgatcttcctgcctaaactcgtgttcaaggacccggaggcattctttcgggataatccggaggcggacgagtttgttttcttatcggggatgaaggctccagtcacaatcactcgggagacgtacgaagcgtatcggtacaaactttacacggtaggtaaattacgcgacggggaggtttccgaagaggaatacaagcgcgccctgctccaggttttaacggcttacaaggagttcctcgagaatcgtatgatttacgcggatcttaactttgggttcaaagatctggaagaatataaagacagtagcgaatttattaaacaggtcgagacccataatacattcatgtgttgggcaaaagtatccagtagtcaattagatgatttggtcaagtcagggaacggcctgttgtttgagatttggtccgagcgcttagagtcatactacaagtacgggaatgaaaaagtactgcgtgggtacgagggcgtacttctgtcgattttaaaggacgaaaatctcgtctcgatgcgcaccctgttaaactctcgtccaatgcttgtttaccgcccgaaagagagttcaaaaccaatggtagtgcatcgtgatggctcccgggttgtggaccggtttgacaaggacggcaaatatatcccacctgaagtacacgatgagctctatcggttctttaacaatttgcttatcaaggaaaaactcggggagaaggcacggaagatcttggataataagaaagtgaaagtaaaagttcttgaaagtgaacgtgtcaagtggagcaaattctacgacgaacaattcgctgtcaccttttcggtgaaaaaaaatgccgactgtctcgacacaacgaaggacctgaatgctgaggttatggaacaatactcagagtcgaatcggctgatcttgatccggaacaccacagacattctctattacctcgtgttagataaaaatggcaaagtcctcaaacagcggagtttgaatattattaatgatggggcacgcgatgtggactggaaagaacgcttccggcaggtgacgaaggatcggaacgaaggctacaatgagtgggactactcgcggacgagtaatgacctgaaagaagtatatttgaactatgctctgaaagaaatcgctgaggcggtcattgagtataatgcgattttgattattgaaaagatgtctaacgcttttaaagataagtattcattcttagatgatgtgactttcaagggtttcgaaacgaaacttttagcgaagcttagcgacttacacttccggggcattaaagatggggaaccatgttccttcactaatcctctgcaactctgccaaaacgactctaacaaaattttgcaggacggtgtaatctttatggtcccaaactcaatgactcggagcttggatccagataccggctttatctttgccattaacgatcataatatccggaccaaaaaggctaaacttaattttctttctaagtttgaccagcttaaggtctcgtcggaagggtgtctgattatgaaatattcgggtgacagtttgccgacccataacaccgataatcgtgtgtggaattgttgttgcaatcatccaattactaactacgaccgggaaacaaagaaggtagaatttattgaagaaccggttgaggagttgtcccgtgtgctcgaggagaacggtatcgagaccgatactgaactgaataaattgaatgaacgtgaaaatgtgccgggcaaggtggttgatgctatttatagcttggtgctcaattaccttcgtggtaccgtgtcaggcgttgctggccaacgggctgtatactactcgccggtgactgggaaaaaatatgatatctcctttatccaagctatgaatttgaatcgtaaatgcgattattatcggattgggagtaaggagcgtggtgaatggaccgacttcgtggctcagttgatcaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1091 - DNA, 3897 bp, synthetic construct
  misc_feature 1..3897: note = Description of Artificial Sequence: Synthetic polynucleotide
  source 1..3897: mol_type = other DNA
atgggccaccatcatcatcatcatagcagcggcctggtgccgcgcggcagcggtaccatgacaatggactatgggaatgggcagttcgagcgccgcgcgccacttaccaagaccatcactctccggcttaaaccaattggcgagacccgcgaaactattcgggagcaaaaactcttagagcaggacgcggcctttcgtaaactcgttgagacagttacgccgatcgtggatgactgtatccgcaaaatcgcagataacgctttgtgtcacttcggcactgagtatgacttcagttgtctggggaatgccattagtaaaaatgactcaaaggctatcaagaaagaaacagaaaaggttgagaaactgcttgccaaggtcctcacggagaacttacctgatgggctccggaaggttaatgatattaatagtgcggcgtttattcaagacacgctcacaagcttcgtccaagatgatgcagacaaacgggtgctgattcaggagctgaaaggtaaaactgttttgatgcagcgtttcctgacgacccgcatcaccgcgttaactgtttggctgccagaccgggttttcgaaaactttaacattttcattgaaaatgcggaaaaaatgcgcattctgctcgacagtccattgaatgaaaagatcatgaaattcgatccggacgctgagcaatatgcatcgcttgaattttacgggcaatgccttagccagaaagatattgactcctataatttgatcatctctggtatctacgcagatgacgaagttaaaaaccctggtatcaacgagattgtcaaagagtataaccaacagatccggggcgacaaagatgagagtccacttcctaagttgaagaaactccacaagcagatcctgatgccagttgagaaggcctttttcgtgcgggtcctttctaacgacagcgatgcccgctctatcttggagaaaattttaaaggacacagaaatgttacctagcaaaattatcgaggcgatgaaggaggcggatgcgggtgacatcgcggtttatggcagtcgcttacatgagttgtctcatgtaatctacggcgatcatgggaaattatcccagatcatttatgacaaggaatctaagcgtatctcagaattgatggaaaccctttctccgaaggaacgcaaggaatccaagaaacggcttgagggtctggaagaacatatccgtaaatctacatatacgttcgacgagttaaaccgctacgcggaaaagaatgtgatggcagcatacattgccgcggtcgaggagtcgtgtgcggaaattatgcgtaaggaaaaagacctgcgcacattattgagcaaagaagacgtcaagatccgcggcaaccgccacaacacccttattgtcaaaaactactttaatgcatggactgttttccgcaaccttatccggattctgcgtcgcaagagcgaagcagaaatcgattctgatttctatgacgttctggatgactcggtcgaggtcttgtccttgacgtacaagggtgaaaatttatgccggtcctacatcactaagaaaatcggttcggatttgaagccggagatcgccacgtacggttccgcgctccggcctaactcacgttggtggtccccaggtgagaaatttaacgttaagtttcatacaattgttcgccgtgacggccggctgtattactttattctcccaaaaggcgcgaagcctgtcgaattagaagacatggatggggacattgaatgtttacagatgcgcaaaatcccgaatcctactatttttcttcctaagcttgtattcaaagatccggaagcattcttccgggacaacccagaagctgacgaatttgtattcctcagtgggatgaaggccccggtaacaattactcgggaaacctatgaagcataccgttataagttatatacggtgggcaagctccgggacggggaggtatcagaagaagaatacaagcgggcgctcctccaggttctcacagcctacaaggaatttcttgagaaccgtatgatctacgcagacttgaattttggtttcaaggatctggaggagtacaaagacagctcggagtttatcaaacaggtggagactcataacacttttatgtgttgggccaaagtatcatcaagtcaacttgatgatctcgttaaatcaggtaatggcctcttgttcgaaatctggagcgagcgtttagagtcctattataagtatggcaacgagaaagtactgcggggctatgaaggcgtactcttatccatcttaaaagacgagaacttagtctcaatgcgcacgcttctcaattcgcgtcctatgcttgtttaccggccaaaggagtcttcaaaaccgatggtggtacaccgggatgggtcacgcgttgtagaccgttttgacaaggacggtaagtatatcccgccagaggtgcatgacgagctttatcgcttttttaacaatcttttaattaaggagaaactcggggagaaagcacgcaaaatcctggacaataaaaaagtcaaagtcaaagtccttgagtcagaacgtgtgaaatggtcaaagttctacgacgagcagttcgctgttacattctctgtaaaaaaaaacgctgattgcttagataccaccaaagaccttaatgccgaagtgatggagcagtatagtgagtcgaaccggcttattctcattcgtaacaccacagatatcttatactatctggtactcgacaagaacggcaaggtgttaaaacagcgttcactgaacatcattaatgatggtgcacgcgacgtggactggaaagagcgtttccgccaggttactaaggaccgtaatgagggttacaacgagtgggactattcccggacgtctaacgacctcaaggaagtctatcttaattatgctctcaaagagattgctgaggccgtcatcgaatacaacgcaattctcatcattgaaaaaatgtctaacgctttcaaagataagtattcattcctcgatgatgtcacctttaaggggttcgaaacgaaattattggctaaactgagtgacctgcacttccgtggcattaaagatggcgaaccatgctcgttcaccaaccctttacaactgtgccaaaacgatagcaataaaatcctccaagacggtgttattttcatggtgccaaatagtatgacccggtcgttggacccggacacgggttttatttttgccatcaatgaccataacatccgcaccaagaaagccaaacttaacttcctgtctaaatttgaccagctgaaggtctcaagcgaaggttgtctgatcatgaaatattccggtgattccctgccgacgcacaatactgacaatcgcgtgtggaattgctgttgcaaccatccaatcacgaattatgaccgtgagactaaaaaggtagagtttattgaggagccggtggaagaactctcgcgggtcctggaagaaaatggcatcgaaactgacaccgaacttaataagctcaacgaacgggaaaacgttccgggcaaagttgtggacgctatttattccttggtcttaaattatttgcgcggtactgtcagtggcgtagcgggccagcgtgcagtttactacagcccggttaccggcaaaaagtacgacatctcgttcattcaagccatgaatctgaaccggaaatgtgattactaccgcattggctccaaagaacgcggcgagtggactgattttgttgcgcagctcatcaatggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1092 - protein, 1306 aa, synthetic construct
  REGION 1..1306: note = Description of Artificial Sequence: Synthetic Cas12a/Cpf1 [Coprococcus sp. AF16-5] sequence
MCYDLNNIKTKLREREVETMGNNMDNSFEPFIGGNSVSKTLRNELRVGSEYTGKHIKECAIIAEDAVKAENQYIVKEMMDDFYRDFINRKLDALQGINWEQLFDIMKKAKLDKSNKVSKELDKIQESTRKEIGKIFSSDPIYKDMLKADMISKILPEYIVDKYGDAASRIEAVKVFYGFSGYFIDFWASRKNVFSDKNIASAIPHRIVNVNARIHLDNITAFNRIAEIAGDEVAGIAEDACAYLQNMSLEDVFTGACYGEFICQKDIDRYNNICGVINQHMNQYCQNKKISRSKFKMERLHKQILCRSESGFEIPIGFQTDGEVIDAINSFSTILEEKDILDRLRTLSQEVTGYDMERIYVSSKAFESVSKYIDHKWDVIASSMYNYFSGAVRGKDDKKDVKIQTEIKKIKSCSLLDLKKLVDMYYKMDGMCLEHEATEYVAGITEILVDFNYKTFDMDDSVKMIQNEHMINEIKEYLDTYMSIYHWAKDFMIDELVDRDMEFYSELDEIYYDLSDIVPLYNKVRNYVTQKPYSQDKIKLNFGSPTLANGWSKSKEFDNNVVVLLRDEKIYLAILNVGNKPSKDIMAGEDRRRSDTDYKKMNYYLLPGASKTLPHVFISSNAWKKSHGIPDEIMYGYNQNKHLKSSPNFDLEFCRKLIDYYKECIDSYPNYQIFNFKFAATETYNDISEFYKDVERQGYKIEWSYISEDDINQMDRDGQIYLFQIYNKDFAPNSKGMQNLHTLYLKNIFSEENLSDVVIKLNGEAELFFRKSSIQHKRGHKKGSVLVNKTYKTTEKTENGQGEIEVIESVPDQCYLELVKYWSEGGVGQLSEEASKYKDKVSHYAATMDIVKDRRYTEDKFFIHMPITINFKADNRNNVNEKVLKFIAENDDLHVIGIDRGERNLLYVSVIDSRGRIVEQKSFNIVENYESSKNVIRRHDYRGKLVNKEHYRNEARKSWKEIGKIKEIKEGYLSQVIHEISKLVLKYNAIIVMEDLNYGFKRGRFKVERQVYQKFETMLINKLAYLVDKSRAVDEPGGLLKGYQLTYVPDNLGELGSQCGIIFYVPAAYTSKIDPVTGFVDVFDFKAYSNAEARLDFINKLDCIRYDAPRNKFEIAFDYGNFRTHHTTLAKTSWTIFIHGDRIKKERGSYGWKDEIIDIEARIRKLFEDTDIEYADGHNLIGDINELESPIQKKFVGELFDIIRFTVQLRNSKSEKYDGTEKEYDKIISPVMDEEGVFFTTDSYIRADGTELPKDADANGAYCIALKGLYDVLAVKKYWKEGEKFDRKLLAITNYNWFDFIQNRRF

SEQ ID NO: 1093 - DNA, 3921 bp, synthetic construct
  misc_feature 1..3921: note = Description of Artificial Sequence: Synthetic Cas12a/Cpf1 [Coprococcus sp. AF16-5] sequence
  source 1..3921: mol_type = other DNA
atgtgttatgatctgaataacataaaaacaaaattacgcgaaagagaggtagaaactatgggcaataatatggataattcgtttgaaccattcattggaggcaactcagtgagtaaaactttacgcaatgaacttagagtgggaagtgagtacaccgggaaacatataaaagagtgtgcaatcatcgcagaagatgcggttaaggccgaaaaccagtatatcgtaaaggaaatgatggacgatttttaccgtgatttcattaatcgaaagctagatgctttacaggggataaattgggaacaactattcgatataatgaagaaggctaagctggataagagtaataaggtttcaaaggaattggataaaatacaggagtctacccgtaaagaaatagggaagatcttctcttcggatcctatatacaaggatatgctaaaagcagatatgataagtaagatcttgccagagtatattgttgataaatatggcgatgcagcttcgagaatagaggctgtaaaagtgttttatggattttcgggttattttattgacttttgggccagtcgaaaaaacgttttttctgacaagaatattgcatcagcaattcctcacaggattgtcaatgttaatgctagaattcacctagataatataactgcttttaatcgaattgcagagattgctggtgatgaggtagcaggaattgcggaagatgcttgtgcttacttgcagaatatgtcactggaggatgtattcacaggagcttgttacggtgagtttatatgtcagaaggatattgatcggtataacaatatatgtggcgtcatcaatcaacatatgaatcaatattgccagaacaaaaagatatccagatcaaagttcaaaatggagagattacacaaacagattttgtgtcgatcggaatcggggttcgagattcccattgggttccagactgatggggaggttatagatgcgatcaattcttttagtactattctcgaagaaaaagatattttggatcgacttagaactttaagtcaggaggttacgggatatgatatggaaagaatatatgtatcctctaaagcttttgaaagcgtatctaaatacatagatcataagtgggatgtgattgcctcaagcatgtataattatttttctggcgctgttcgcggtaaagatgacaaaaaagatgtaaagatacaaacagaaattaaaaaaataaagagttgtagtttgcttgatttgaagaaacttgtggatatgtattataaaatggatggaatgtgtctggaacatgaggcaacagagtatgttgcaggaataacagagatattagttgattttaattataaaacctttgacatggatgattcagtcaagatgattcagaatgagcatatgataaatgagataaaggagtatcttgatacttacatgagtatctatcattgggccaaggattttatgattgacgagttggttgatagggatatggagttctattcggagcttgatgagatatattacgatttgtctgatatagtacctctttataataaagtgaggaattacgttacgcagaaaccatatagtcaggataagataaagctaaatttcggctccccaactcttgcaaatggatggtcaaagtcgaaggagtttgacaacaatgtcgttgttctcttgcgcgatgaaaagatatacctggcaattttaaatgttggcaataaaccttcaaaagatattatggcaggagaggacaggcgtagaagtgatacagactataagaagatgaattattatctgctcccaggagcaagtaagacattgccacatgtattcattagctcaaacgcttggaaaaaatcgcatggaataccagatgaaataatgtatggatataaccagaataaacatctaaaatcatcgccgaattttgatttggagttttgtcgtaaactgattgactattataaagaatgcattgattcctatccaaactaccagatctttaattttaaatttgctgctacagaaacctacaatgatatatcagagttttacaaggatgtagagagacagggatataagatagaatggtcctatattagcgaagatgatattaaccagatggaccgagatggtcagatatatttatttcagatatacaataaagacttcgctccgaatagtaagggaatgcagaatctacatacactatatctgaagaatatattcagtgaggagaatcttagtgacgttgtcataaagctcaatggtgaggccgaattgttcttccgaaagtcaagtattcagcataaaagaggtcataagaagggctcggtactagtcaataaaacatacaaaacaacagaaaaaactgagaatggtcaaggtgaaattgaggtcattgagtctgtgcctgatcaatgttacctagaactggtaaagtattggtcagagggtggtgtaggacagctctcggaggaagcctccaagtataaggataaagtatcacactacgcagccaccatggatatagttaaggatcgtagatatacagaagataagttttttattcatatgcctattacgatcaatttcaaagctgataacaggaataacgtgaatgaaaaagtcttaaaattcatagcagaaaatgatgatcttcatgtgatcggaatagataggggagagagaaatcttctatatgtatcggtgattgatagtaggggcagaattgttgagcagaagtcatttaatatagttgaaaattacgaatcatctaaaaatgtaattagacgacatgattacaggggtaaacttgtgaataaggaacactatagaaatgaagctagaaagagttggaaggaaataggaaagataaaggagataaaagagggttatctgtcacaggttatccatgagatatcgaaactcgtattgaagtataatgctatcatagttatggaggatctgaattatggatttaagagaggtcgtttcaaagttgaacgtcaggtttaccagaagtttgagactatgttgataaataagctggcatatttggtagataagagccgtgcagtagatgaacctggaggattgctcaagggttatcagctcacttatgtacctgataatttgggcgagctgggcagccagtgtggcattatcttttatgttccggcagcgtatacgtcaaagatagaccctgtgacgggatttgtggatgtgtttgacttcaaggcttattccaatgctgaagccagacttgactttatcaataagcttgattgtataaggtatgatgcacctaggaataagtttgagattgcatttgattatggcaattttaggactcaccatacaactcttgcaaaaactagctggactatatttattcatggtgatcgaatcaaaaaggaacgtggatcttatggctggaaagacgagattatagatattgaagcaagaataaggaaactgtttgaagatacggatatagaatatgcagatggtcataacttgattggggatatcaatgagttggaatctcctatacagaaaaagtttgtaggtgaattgtttgatattattagatttacagttcagcttcgtaacagtaagtctgaaaagtatgatgggacagaaaaagagtatgataaaatcatatctccggttatggatgaagaaggagtattcttcactactgatagttatattcgtgcagatggaacagagcttcctaaggatgctgatgcaaatggagcgtattgcattgctctaaagggcttatatgatgtgttggcagtaaagaaatactggaaggaaggcgagaagttcgataggaaactgttagcaatcactaattacaattggtttgattttatacagaacagaaggttctag

SEQ ID NO: 1094 - DNA, 4110 bp, synthetic construct
  misc_feature 1..4110: note = Description of Artificial Sequence: Synthetic polynucleotide
  source 1..4110: mol_type = other DNA
atgggccaccatcatcatcatcatagcagcggcctggtgccgcgcggcagcggtaccatgtgttatgacctcaacaatattaagacaaagcttcgggagcgtgaggtggagacgatgggcaataatatggacaatagtttcgagccatttatcggcggcaattccgtaagcaaaacgcttcgtaatgagcttcgtgtgggtagtgagtataccgggaaacatatcaaggaatgtgccattatcgccgaagacgcggtaaaggccgagaatcaatatattgttaaggagatgatggatgatttttatcgcgattttatcaaccggaagcttgacgcgctgcaaggcattaactgggagcaattgttcgacatcatgaagaaggcgaagctcgataaatcaaataaagtctcgaaagaattggataaaatccaagagtccacgcgcaaagaaattggtaagattttcagctcggacccaatctataaggatatgctcaaagccgacatgatctcaaaaatcttgcctgaatatattgtagacaaatacggggatgccgcttcccgtattgaagccgtaaaggtattttatggcttctcaggctattttatcgacttttgggcaagccgtaagaacgtgttctcagataagaacatcgcatcagcaatccctcatcgcattgtcaacgttaatgctcgtattcacttggacaacattacagcctttaaccgcattgcagaaattgctggtgacgaggtcgcgggcatcgcagaagacgcctgcgcctaccttcagaatatgtcactcgaggatgtctttactggcgcatgctatggggaattcatctgtcagaaggacattgatcgctataacaatatttgcggtgtgattaaccagcatatgaatcagtattgccagaataagaagatttctcgctctaaatttaagatggaacgcttgcacaagcaaatcctgtgtcgctcggaaagcggctttgaaatccctatcggttttcagactgatggtgaggtcatcgatgctatcaactcatttagcacgatcttagaggagaaggatattctcgatcgtcttcgcacccttagccaagaggtgacgggctacgatatggaacgcatctacgtgagtagtaaagcttttgagagtgtgtcaaaatatattgaccacaaatgggacgttattgcctcctcgatgtacaactacttctccggtgctgttcgcggtaaagatgacaaaaaggacgttaagatccaaactgagattaaaaagattaagagttgtagtttattggatttaaagaaattagtagacatgtattacaaaatggacggtatgtgtcttgaacatgaggctactgaatatgttgcaggcatcactgaaatcctcgtagactttaattacaagacttttgatatggacgatagtgtcaaaatgatccaaaacgaacatatgattaacgaaatcaaggagtaccttgacacatacatgtcaatttatcattgggcgaaggacttcatgatcgatgagttagtggaccgcgacatggaattctactcggagctggatgagatctattatgatcttagcgacatcgttcctctctacaataaagtccgcaactacgtaacacagaagccgtactcgcaggataaaatcaagcttaactttggttcgccgacgttggcgaatgggtggtccaagagtaaggaatttgacaacaatgtagttgtgttgctgcgcgatgaaaagatctaccttgcaatccttaatgtaggcaataagccatccaaggatatcatggccggtgaagatcgccgccgcagtgatacggactataaaaaaatgaattattatcttctcccgggggcatctaaaaccctccctcacgtgttcatttctagcaacgcttggaagaaatcccacggcatcccagatgagatcatgtacggctataatcagaacaagcatcttaagtccagcccaaatttcgacctcgagttctgccgcaaattaatcgactattacaaagaatgcattgattcgtatccgaactaccagatcttcaactttaaattcgctgccacggaaacttacaacgacatttcagaattctacaaggatgtggagcgtcaggggtacaaaatcgaatggtcatatatttcggaggatgacattaaccaaatggaccgtgacggccaaatctatttgtttcagatctacaataaagactttgcgccgaattctaaaggcatgcaaaacttgcataccttatatttaaaaaacatctttagtgaggaaaatttgagcgacgtcgtaatcaaactgaacggcgaagcagagttattttttcgtaagtcctctattcagcataagcgcgggcacaagaaaggctcggtgctggtgaacaaaacatacaaaacaaccgaaaaaacagaaaacgggcaaggggagattgaggtgatcgagagcgtgcctgaccagtgctatcttgagcttgtgaaatactggtcagaagggggtgtaggtcagcttagcgaggaagcgtcgaaatacaaggacaaagtctcgcactatgctgcgacaatggacattgtcaaggatcgccgctatacagaagataaattttttatccatatgccgattacaatcaattttaaggccgataaccgtaacaatgttaacgagaaagttctcaaatttatcgcggaaaatgacgaccttcatgtaattggtatcgaccggggggaacggaacttgctttacgtatcggtcattgattcccgtggtcggatcgtggagcaaaaaagcttcaacatcgttgagaactatgagagcagcaagaacgtaatccgtcgtcacgattaccgggggaaacttgtgaacaaagaacactaccgcaacgaggcacggaaatcatggaaggagatcgggaagatcaaagaaattaaagagggttatttaagtcaggtcattcatgagatttctaagcttgttcttaagtataatgctattattgtcatggaggacctgaattatgggtttaagcgtggccgctttaaggtcgaacggcaggtttaccaaaagtttgaaactatgcttatcaataaattggcgtatcttgtcgacaagagccgtgcggtcgacgagccgggtggtcttctgaaagggtatcaactcacttacgttcctgataatctcggcgagttgggttcgcaatgtggtattatcttttacgtcccggccgcctatacatcaaaaatcgaccctgttactggttttgtagatgtttttgacttcaaggcttactcgaacgctgaggcacgcctggattttatcaataagctggattgtatccgttatgatgcaccgcgcaacaagtttgaaattgcattcgactacgggaatttccgcacgcatcatactacgttagcaaagacatcatggactatttttattcatggggatcgcattaaaaaagagcgcggtagctatggctggaaagacgaaattatcgatatcgaagcccggattcgtaaactgttcgaagatacagatatcgagtatgccgacggccataatttgattggcgatatcaatgagctcgaatccccgattcagaagaaatttgtcggcgagctgtttgacatcattcgctttactgtacagctgcgcaattccaaatcggaaaaatacgatggcactgaaaaagagtatgacaaaatcatttctcctgtaatggacgaagaaggcgtgtttttcactactgacagttatatccgtgcggacggcaccgagcttccaaaggacgccgatgctaatggcgcttattgcattgccctcaaggggctctacgatgttttagcagtaaagaaatattggaaggaaggtgaaaaattcgaccggaaattacttgccattacaaactacaattggttcgattttatccagaaccgccgctttggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1095 - DNA, 4110 bp, synthetic construct
  misc_feature 1..4110: note = Description of Artificial Sequence: Synthetic polynucleotide
  source 1..4110: mol_type = other DNA
atgggccaccatcatcatcatcatagcagcggcctggtgccgcgcggcagcggtaccatgtgttatgatctgaacaatattaagacaaagctgcgggagcgtgaagtggagacgatgggtaataacatggataattcgtttgaaccttttattggtgggaattcagtctctaagactctccgtaacgaactccgtgtcggcagtgaatacacaggcaaacacatcaaggaatgcgcaattatcgcggaggacgcagttaaagccgagaaccaatacatcgtaaaggagatgatggacgacttttaccgggattttattaatcgtaagcttgatgccttgcaggggattaactgggagcagttattcgacatcatgaaaaaagcaaagcttgacaagagtaacaaagtgtcgaaggaattggataagatccaagaaagcactcgtaaggaaattggtaagatttttagttcagatcctatttacaaggacatgttgaaagcggacatgatcagcaagattttacctgagtacatcgtggataaatacggtgatgctgctagtcggattgaggcggtaaaagtgttttacggcttctctggctattttattgatttttgggcgtcacggaaaaatgtgttttccgacaaaaatattgctagtgctattccgcatcgtattgtcaatgtgaatgctcggattcatcttgataatattacggccttcaatcgcattgccgaaatcgccggtgatgaagtagcgggcattgcggaagatgcatgtgcataccttcagaatatgtcccttgaggatgtcttcacaggtgcatgctacggggagtttatttgccagaaggacattgaccgctacaacaatatttgtggcgtaatcaaccaacacatgaatcaatattgtcaaaacaaaaaaatttcccgtagcaaatttaagatggagcgcttacataagcagattctttgccgcagcgagtccgggttcgagattccgattggttttcagaccgatggggaagtaattgatgcgattaactccttctcgacgattttagaagagaaggatatcttggaccgtctccgtacattaagccaagaggtaaccgggtacgatatggaacgtatctatgtatcgagtaaggcgttcgaaagtgtcagcaaatacatcgatcacaagtgggacgttattgcttcgagcatgtacaattatttctcaggcgcggttcggggcaaagatgataagaaagatgttaaaattcaaacagaaatcaagaaaatcaagtcgtgctccttattagatctcaagaagctggtagacatgtactacaaaatggacggtatgtgtttggaacacgaggcaaccgagtacgtagctggtattacggagattcttgttgactttaactacaagacattcgacatggatgactcagtgaagatgatccagaacgagcacatgatcaacgagattaaggaatatttagacacctacatgagcatttatcactgggcaaaagattttatgattgatgagctcgtagaccgtgatatggaattctactccgaacttgacgagatctattatgatcttagcgacattgtcccgctttataataaggtacgtaattacgtcacccagaaaccatactcccaggacaaaattaaattgaactttgggtcacctaccttagcgaacggctggagtaagtctaaggaattcgataataacgttgtggttctcctgcgggatgaaaagatctatctcgcgatcctgaatgtcgggaacaaaccttccaaggacattatggcaggtgaggaccgccgccggtcagacactgactacaagaaaatgaattattatcttctgccaggggcctcaaagacattgccgcacgtctttatcagtagcaatgcatggaagaagagtcacggcatcccagacgagatcatgtatgggtataaccagaataagcacctgaagtcgtcgccaaactttgatttggaattctgtcgcaaattgatcgactattataaagaatgtattgactcatacccgaactatcaaatttttaattttaagttcgccgccacagagacatacaatgatatttcggagttctataaggacgtcgagcgtcaaggctacaaaattgagtggagttacatctccgaggatgacatcaaccagatggaccgtgatggccaaatctacttatttcagatttacaacaaggattttgcaccaaattcaaaggggatgcagaacttacacactctgtacctcaagaatattttttctgaggaaaatctctctgacgtagttatcaaactcaatggtgaagcggagttgtttttccggaagagctctattcagcataaacgtgggcacaagaagggttctgtgttggtaaacaaaacctataaaacgactgagaagaccgagaacggccagggtgagattgaggtaatcgaatcggttccggatcaatgctatcttgagcttgtgaagtactggtcggaagggggcgtcgggcaactttcggaggaggcaagcaaatataaagacaaagtctcacattacgctgcaacaatggatatcgtaaaagaccgccgttacacggaagataagtttttcattcatatgcctatcaccattaatttcaaagccgataatcggaataatgtcaatgaaaaggtccttaagtttatcgcagaaaatgacgaccttcacgtcatcggtatcgaccgcggcgagcgtaacctcctctacgtatcagtaattgactcccgcgggcggattgtcgagcagaagagcttcaatatcgttgaaaactatgagtcgtctaagaatgtgattcggcgccatgattaccgggggaaactggtcaacaaggagcactatcggaatgaggcgcgcaagtcttggaaagagatcggtaaaatcaaggaaattaaagaagggtatttgagtcaagtaattcatgagattagtaagcttgtcttgaaatataatgcgattattgttatggaggacctcaactatgggttcaaacgtggtcgtttcaaagtcgagcgccaggtctaccaaaagttcgagaccatgcttattaataaattagcgtacttggtggacaagtcacgcgctgttgatgagccgggcggcctcttgaagggttatcaattgacatacgttcctgacaaccttggtgagttgggttcacagtgtggtatcatcttctatgtaccagcggcgtacacatcaaagattgacccagtcacaggtttcgtggacgtctttgattttaaagcatacagcaatgcggaggcccgcttagacttcattaacaagctcgactgtatccggtacgacgctcctcgtaacaaattcgagattgccttcgactacggtaattttcgcactcaccatacgaccctggctaaaacttcctggacgatctttattcatggtgaccgtatcaaaaaggagcgcgggagctatgggtggaaagatgagattatcgacattgaggcccggatccgcaagcttttcgaagataccgatatcgaatatgctgatggtcacaaccttatcggtgacatcaacgaattggagagtccgattcagaaaaagtttgtaggggagcttttcgatatcattcggtttaccgtccagttacgcaactccaaatcggagaagtacgacggcaccgaaaaggaatatgacaagatcatttcacctgtcatggacgaggagggcgtgtttttcactactgatagctatattcgtgcggacggcacggaacttccaaaggatgccgacgccaacggcgcatattgcattgccttgaagggcctctatgacgtcctggcagttaaaaagtactggaaagagggtgaaaagttcgaccgcaaattattggccatcaccaattacaactggttcgactttatccaaaatcggcgttttggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1096 - DNA, 4110 bp, synthetic construct
  misc_feature 1..4110: note = Description of Artificial Sequence: Synthetic polynucleotide
  source 1..4110: mol_type = other DNA
atgggccaccatcatcatcatcatagcagcggcctggtgccgcgcggcagcggtaccatgtgctacgatctcaataacatcaagacaaaactgcgggagcgtgaagtggaaacgatggggaacaatatggataactcattcgagccatttattggtggcaactccgttagcaaaactctccgcaatgaactgcgggtagggtcggaatatacaggtaaacacatcaaggagtgtgcaattattgcggaagacgcggtcaaagctgagaaccagtacatcgtgaaagaaatgatggacgacttttatcgtgatttcatcaaccgcaaacttgacgcgcttcaaggtattaactgggaacagttattcgatattatgaagaaagctaagctggataagagcaacaaagtatctaaggaattggacaaaatccaggaatccacacggaaggaaatcgggaaaattttttcgagcgatccaatctataaggacatgctcaaagcggatatgatctccaagatcctcccggaatatattgtggataagtatggcgatgccgccagtcggattgaggctgttaaggttttctatggtttcagtggctacttcatcgacttctgggcgagtcgcaaaaatgtatttagcgacaaaaatattgcctcggcaattcctcaccggattgtgaatgtcaatgctcgcatccacttagataacattacagcctttaaccgtattgctgagattgcaggggacgaggtggccggcatcgccgaagacgcttgcgcttaccttcagaatatgagcttggaggacgtctttacgggcgcgtgttacggtgagtttatttgtcaaaaagatatcgaccggtataataacatctgcggggtcatcaatcagcacatgaaccaatactgccaaaacaagaaaatttcacgtagtaaattcaagatggagcggctccacaagcagatcttgtgtcggtccgagagtggtttcgagatccctattggcttccagaccgacggggaggtcattgacgccattaattccttttccacgatcctggaagaaaaggacatccttgaccggcttcggacgctttcccaagaggtcacgggttacgatatggaacggatctacgtgtctagtaaagctttcgaatcagtatctaagtatattgaccataagtgggacgtaattgcttcctccatgtacaattatttctctggggcagtacgtgggaaggatgataagaaggatgtgaaaatccaaaccgaaattaagaagattaaatcatgtagtctcttggacctcaaaaagctggtcgatatgtactacaaaatggatgggatgtgtctcgagcatgaggctacagagtacgtcgctgggatcactgagattctggtggatttcaactacaagacctttgacatggatgatagtgtgaaaatgattcagaatgagcatatgattaatgaaattaaagaataccttgatacctacatgtcaatttatcactgggcaaaggactttatgatcgatgaactcgttgaccgcgatatggaattctattccgaattagatgagatctactacgacctttcggatattgttcctctctataataaagtccggaactatgtaacccaaaagccttactcacaagacaaaatcaaactcaatttcggcagccctacgctcgctaatgggtggtcgaagagtaaggaattcgataacaacgtggtcgtgctgcttcgggatgaaaaaatttatttagcgattttgaacgttggcaacaagccgagtaaggatattatggctggtgaagaccggcggcgctcggacactgactataaaaaaatgaactactaccttcttccgggggcgtcaaagacactcccgcacgtattcatctcctcgaacgcatggaagaagagccacgggatccctgatgaaatcatgtatggttacaatcagaataagcatttgaaatccagcccaaattttgacctcgagttttgtcgcaaacttattgattactataaagaatgcatcgatagctatccaaactatcaaatctttaacttcaaattcgctgcaacagagacttataatgacatttcagaattctacaaggatgtcgaacgccagggctataaaatcgaatggtcctatatcagcgaggatgatattaatcagatggaccgggacggccagatttatttgttccaaatttacaacaaggatttcgcaccgaatagtaagggtatgcaaaacttgcacaccctctatcttaaaaatatcttcagtgaggaaaatttatcggacgttgtaatcaagttgaatggggaggcagagcttttcttccgtaagtcaagtatccagcataagcgggggcacaaaaagggctccgtactcgtgaacaaaacatataaaaccacagagaagacggaaaatggccaaggtgagattgaggtcatcgaaagcgttccggatcagtgctatctcgagctggtcaagtactggtctgagggcggtgtcggtcaactctctgaggaagcaagcaagtacaaggacaaagtatcccactacgctgctacgatggacattgtcaaagatcgtcgttacacagaggataaattttttatccatatgccaattacgatcaatttcaaggcggataatcggaataacgtgaatgaaaaagtattaaaatttattgcggaaaatgacgacctccacgttatcggcattgatcgcggggagcgcaatttactctatgtaagtgttattgattcccggggccgtattgtagaacagaaaagctttaacattgtagaaaattatgaatcctccaagaatgtcattcgccgtcatgattaccgcggtaagcttgtaaataaggaacactatcgcaatgaggctcggaagtcttggaaggagatcgggaaaatcaaggagatcaaagaaggttaccttagccaggtgattcatgagatctctaaactggttcttaaatacaacgcgatcattgttatggaagacctgaattatggttttaaacgtgggcgctttaaagttgagcgtcaagtttaccaaaaatttgaaactatgttgattaacaagttagcgtaccttgttgacaaaagtcgggctgtagatgaaccgggtggcctgctcaaagggtatcaactcacttacgtcccggataatttaggcgaattaggtagccaatgcggcattatcttctacgtaccggctgcatacacctcaaagatcgacccggtgacggggtttgtggatgtctttgacttcaaagcttactcaaatgctgaggcacggctcgattttattaacaaacttgactgtatccgttacgatgcaccgcgtaacaaatttgaaatcgcctttgactacggtaattttcggactcatcatacaactcttgctaagacaagctggaccatcttcattcatggcgatcgcattaaaaaagagcgtggcagctatgggtggaaagatgagattattgatatcgaagctcgcatccgcaaactgtttgaagataccgacatcgaatacgcggatgggcataatttgatcggggacatcaacgaattagagagccctatccagaagaaatttgtaggtgaactttttgacattattcggttcaccgtgcaattgcgtaattccaagagtgagaaatacgacggtaccgagaaggaatatgacaaaattattagtccggtaatggatgaagagggtgtcttcttcacaaccgacagttatattcgggccgatggtacggaattacctaaggatgcggacgcaaatggggcttattgcattgctctcaaaggtctctacgatgtgctggcagtaaagaaatactggaaggagggcgagaaattcgatcgcaaacttctcgcaattaccaattacaattggtttgatttcattcaaaatcgtcggtttggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1097 - DNA, 4110 bp, synthetic construct
  misc_feature 1..4110: note = Description of Artificial Sequence: Synthetic polynucleotide
  source 1..4110: mol_type = other DNA
atgggccaccatcatcatcatcatagcagcggcctggtgccgcgcggcagcggtaccatgtgctacgaccttaataacattaagactaaactgcgtgagcgcgaggtcgagacgatgggcaataatatggacaactctttcgaaccttttatcggggggaactccgttagtaaaaccttgcggaatgagttacgtgtggggagtgaatataccggtaaacacatcaaggaatgcgccatcattgcagaggatgcagtgaaggcggaaaatcagtatattgtcaaagagatgatggacgatttctatcgcgactttatcaaccggaaacttgacgcgctgcagggcattaattgggagcagttattcgatatcatgaagaaagcaaagcttgataagtcgaacaaagtctctaaagaactcgataagattcaggaatcaacccggaaagaaattggtaagatctttagcagtgatcctatttacaaagatatgttaaaagctgatatgatctccaaaatcttgcctgagtacatcgtcgataagtatggcgacgccgcttcacgtatcgaggccgtgaaagtgttctatggtttctcaggctatttcatcgacttttgggctagtcggaaaaatgtcttctccgacaaaaacatcgcttccgccattccacatcgcattgtaaacgttaatgcgcggatccatctggacaacatcaccgcctttaatcggattgccgagatcgcaggtgacgaggtcgcgggcatcgctgaagatgcctgtgcgtatctgcagaatatgagcttggaggacgtttttactggcgcatgttacggcgagttcatctgccagaaggacattgaccgttacaataacatctgcggtgttatcaatcagcatatgaaccagtactgtcagaataaaaagatcagccgcagcaaattcaagatggaacgtttacacaagcaaatcttatgccggagcgaatcagggtttgaaattccgattggttttcagacggatggtgaagtaatcgatgcaattaattctttctctactatcttagaagagaaggacatcctcgatcggcttcggactcttagccaggaggtgactgggtatgatatggagcggatttatgtttcgtccaaggcctttgagtctgtcagcaaatacatcgaccacaaatgggatgtgatcgcgtccagtatgtataattacttttctggcgccgtgcgtggcaaagatgacaaaaaggatgtaaaaattcagaccgaaatcaaaaagattaagtcttgttcgttgctcgaccttaaaaaactcgttgacatgtactataaaatggatggcatgtgtttagagcatgaggccacggagtatgtggccgggatcacggagattttggtagatttcaactacaaaactttcgacatggatgattccgttaagatgattcagaatgagcatatgattaacgaaattaaagaatacttggatacctacatgtccatttaccactgggcgaaagacttcatgatcgacgaacttgtcgatcgcgatatggagttttattcagaattagatgaaatttactatgacttgtcggacatcgtaccgctctataataaggttcggaattacgtcacccagaagccatatagccaagataagatcaaattaaatttcgggagcccaacactcgcaaatggttggtccaaatcgaaggaattcgacaataacgttgtagtgctgctgcgtgacgagaagatttaccttgctatcttaaacgtgggtaacaagccaagcaaagacattatggcgggggaagatcgtcggcgtagcgataccgattacaagaaaatgaactactatttattgcctggggctagcaaaacccttccgcacgttttcattagctcaaatgcttggaagaagtcacatgggattccagatgagatcatgtatggttataaccagaacaaacatctgaaatcaagtcctaatttcgacttagaattctgccgtaagttaattgactactacaaagaatgcatcgacagttatccgaattatcaaatttttaacttcaagtttgcagcgaccgaaacctacaacgatatctccgaattttacaaggatgttgagcggcaggggtataaaatcgagtggagttacatctctgaagatgacattaaccaaatggaccgtgatggtcagatctacctcttccaaatttacaacaaggacttcgcacctaattcgaaaggcatgcaaaatctgcacactttgtacctgaagaacatcttctcggaggagaatttatctgatgtagtgattaagctgaacggggaggctgaactcttctttcgcaaaagttcgattcagcataaacgtgggcataagaagggcagtgtacttgtcaacaagacctataagactaccgaaaagacagagaacgggcagggcgaaatcgaggttatcgagagtgttcctgatcagtgttatttggagttggtaaaatattggtccgaagggggtgtaggccagttgtcggaggaggctagcaaatacaaagacaaagtttcccattatgccgcgacgatggacatcgtgaaggaccgtcgttatactgaagacaaattcttcatccatatgcctatcactatcaacttcaaagctgataaccggaacaatgtaaacgaaaaggtgttaaaattcattgcggaaaatgacgatctccatgtcatcggcattgatcgtggtgagcgcaacctgctttacgtgtcagtcattgatagtcgcgggcggattgtggagcaaaagagttttaacattgtggagaattacgagtcctctaaaaatgtgattcgtcgccatgattaccggggtaagctcgtcaataaggaacactatcggaatgaggctcgcaaatcttggaaggaaatcggtaagatcaaggagattaaggagggctatctctctcaagtcatccacgagatctcgaagcttgtattaaagtacaacgcgatcattgtaatggaagatttgaactatgggttcaagcgggggcggttcaaagtggagcggcaggtgtaccaaaaattcgaaactatgttaatcaataaactggcttacctggtcgataaatctcgcgcagtggatgaaccaggggggcttttgaaggggtatcaactcacttatgttcctgacaaccttggggagctcggttcccagtgcgggattatcttttatgtgccagccgcatacacgagtaagatcgatccggttaccggctttgtagacgtttttgacttcaaagcatatagtaacgcagaggcacgcctcgatttcatcaacaaactggactgcattcgctacgatgcaccacgtaataagttcgaaatcgcgtttgattatggcaactttcgcacgcaccacacgactttagcgaaaacgtcttggacaattttcattcacggcgatcgcatcaagaaggagcgcggctcgtacgggtggaaggacgaaattattgatatcgaggcacggattcgtaaactttttgaggacacagatattgagtatgctgacggccataacctcattggcgatatcaatgagcttgagtcacctatccaaaaaaaattcgttggggaacttttcgacattatccgttttacggtgcagctccgcaactcgaaatcagaaaaatatgatggcacggagaaagagtacgataagatcatctctcctgtgatggatgaagagggcgtcttcttcaccactgattcgtacattcgtgcggatgggacggagttaccgaaggacgctgatgctaatggcgcctactgtatcgcgctcaagggcctgtacgacgtcttagctgtcaagaagtattggaaggagggtgagaaattcgaccggaagttactggcgatcactaactacaattggtttgactttatccaaaatcgccgttttggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1098 - DNA, 4110 bp, synthetic construct
  misc_feature 1..4110: note = Description of Artificial Sequence: Synthetic polynucleotide
  source 1..4110: mol_type = other DNA
atgggccaccatcatcatcatcatagcagcggcctggtgccgcgcggcagcggtaccatgtgttacgatctgaacaacatcaaaacgaagctgcgcgagcgcgaagttgaaacgatggggaataacatggataattcgttcgaaccgttcattggggggaattcagttagcaagaccctgcggaatgagttacgtgttggctctgagtacacaggcaagcatattaaggaatgcgctatcattgctgaggacgccgtgaaagccgaaaaccagtatattgtgaaagagatgatggacgacttttaccgtgacttcattaatcgtaagctggatgcgctccaggggattaattgggaacagctgttcgatatcatgaagaaggccaaactcgataagtcgaataaagttagcaaagagctggacaagattcaggaatcgactcggaaagagattggtaaaatcttcagttctgacccgatttacaaggatatgcttaaagctgacatgatttcaaaaatcctgccagaatatattgttgataagtacggcgatgcggcatcacgtattgaagctgttaaagtgttttatggtttttcggggtattttatcgatttttgggcttcacgcaaaaatgtgttttcagataagaacatcgcgtcggcaattccgcaccgcatcgtaaacgtcaatgctcgcattcacctcgacaacatcacggcattcaaccgcattgcggagatcgcgggggacgaagtcgctggcattgccgaggacgcttgcgcatatctgcagaacatgagccttgaagacgtattcactggtgcctgttatggcgagtttatctgtcaaaaagacattgatcgctataataacatttgcggggtgatcaaccagcatatgaaccaatactgccaaaataaaaaaatctcccgctcaaaatttaagatggagcgcctgcataaacaaatcctttgtcggtccgagagtgggttcgagatcccaatcgggttccaaacggacggcgaagttattgatgcgatcaacagtttttcaacaattcttgaggagaaagacatccttgaccgtcttcggacattatcgcaagaggtaaccgggtacgacatggaacgtatttacgtctcatcgaaagcgttcgagtccgtctctaagtacatcgaccataagtgggatgtcattgcatcatcgatgtacaattatttttctggtgcagttcggggcaaagatgataaaaaggacgtgaagatccagacagaaattaaaaaaatcaagagctgttccctgctcgacttaaagaaacttgtcgatatgtactacaagatggacggtatgtgcttggagcatgaggccacggagtatgtcgctggcatcactgagattctggtagattttaactacaagacctttgacatggatgattccgtcaaaatgattcaaaacgaacatatgattaatgagattaaagagtacctggatacctatatgtccatttatcattgggcaaaagattttatgattgatgagctggtcgaccgtgacatggagttctactcggaattggacgaaatttactatgatctgtcggatattgtaccactttacaataaggttcggaattatgttacgcagaaaccgtactctcaggataagatcaaacttaattttggctcgccgactctcgctaatggttggtcaaagtccaaagagttcgataacaacgtagtagttcttctgcgggacgagaagatttacctggcaatcctcaatgtagggaataaacctagtaaagatattatggcgggggaagaccgccgccgcagtgatacggactataaaaaaatgaattattacctccttccgggtgcgtctaagaccttgccacatgtttttatttcttccaacgcgtggaaaaagagtcacggcattccggacgaaatcatgtatggttataatcagaataaacacctcaagtccagccctaactttgaccttgagttctgccggaagctgattgattattataaggaatgtatcgattcttacccgaactatcagatctttaacttcaaatttgccgcaactgaaacatacaatgacatcagcgagttctataaagatgtggaacgccaagggtacaaaattgaatggtcatacatctccgaggacgacattaatcaaatggaccgggatggtcagatttacttattccagatttataacaaggactttgccccaaattcaaaaggcatgcaaaacctccataccttgtacttgaaaaatatcttctccgaggaaaatctttccgacgttgtgatcaaacttaacggggaagcagagcttttctttcgtaagtcgtctatccaacataaacgggggcacaaaaaaggcagcgttctggtgaataaaacgtacaagaccactgagaaaacggagaatgggcaaggcgaaattgaggtcatcgagtcggttccagatcagtgctatctcgagctcgtaaaatactggtccgagggtggtgtgggccagttatcagaagaggcctcgaagtacaaagataaggtctctcactacgctgccacgatggatattgtcaaggaccgccgctacactgaagacaaatttttcattcacatgccgatcacaatcaacttcaaggccgataaccggaacaacgtgaacgaaaaagtactgaagtttatcgccgaaaatgatgacttgcatgttattggcattgaccggggtgaacgcaatttactctacgtatcggtgattgacagtcggggccgtatcgttgagcagaagagtttcaacatcgtggaaaattacgagtccagtaaaaatgttatccggcgtcacgattaccggggcaagctggtgaataaggagcattatcggaatgaagcgcgcaagtcttggaaagaaattggcaaaattaaggagattaaagaaggttatctctcccaagtaattcacgagatttcaaagttggtcttgaagtataacgcgattattgtgatggaagacttgaactacggttttaaacgcggccgttttaaagtggagcggcaggtataccagaaatttgaaacaatgctgatcaacaagctggcgtatttggtggataagtcgcgcgccgttgatgagcctggggggttgctgaagggttaccaattaacttatgttcctgataacttgggggagttaggttcacagtgtggcattatcttctacgttccagccgcttatacttccaaaattgacccagtgacaggtttcgtcgatgtattcgatttcaaggcatattccaatgctgaggcgcgccttgatttcattaataaattggattgcattcggtatgatgctccgcgtaacaagttcgaaatcgccttcgactacggtaacttccggacacaccatacaaccctggccaagactagctggaccatcttcatccacggcgaccggattaaaaaggaacggggcagctatggttggaaagacgaaattattgatattgaggcccggatccggaagctgtttgaagacaccgacattgaatacgctgatggtcacaatttaattggggatatcaacgagctggaatcgcctattcagaaaaagttcgtcggcgaattattcgacatcattcggttcaccgtgcaactgcgcaactccaaatcagaaaagtacgatggcacggagaaagagtacgacaaaattatttccccggtgatggacgaagagggtgtttttttcacaactgattcgtatatccgggcggatggtaccgagcttccgaaagacgctgacgccaatggcgcttactgcattgctttaaagggcttgtatgatgtactggcggtcaagaagtactggaaggaaggcgagaagtttgatcgcaagttgcttgccatcactaactataactggtttgattttatccaaaaccgtcggttcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1099 - DNA, 4110 bp, synthetic construct
  misc_feature 1..4110: note = Description of Artificial Sequence: Synthetic polynucleotide
  source 1..4110: mol_type = other DNA
atgggccaccatcatcatcatcatagcagcggcctggtgccgcgcggcagcggtaccatgtgctacgatcttaacaatattaaaactaagttgcgcgaacgtgaggtagaaacaatgggtaataacatggataattcgttcgagcctttcatcggcggtaatagcgtctctaagaccctccgtaatgagttacgggtgggctcagaatataccggcaagcatatcaaggagtgtgccattattgccgaagacgctgtgaaggcggaaaatcagtatatcgtcaaagagatgatggacgatttttaccgcgactttatcaatcgcaaattagatgcgttacaaggcattaattgggagcaattatttgacattatgaaaaaagcgaaacttgacaagtcaaacaaagtttcgaaagaacttgacaaaatccaagaatcgacgcgcaaagagatcgggaagatcttcagcagtgatccgatttacaaagacatgttaaaagcggacatgatctcaaagatcctccctgaatatatcgtagataagtatggggatgcggcgtcacggattgaagcggtgaaagtgttttacggttttagtgggtatttcattgacttttgggcctcgcgcaagaacgtcttttccgacaaaaatatcgcaagtgccattccacatcggatcgtcaatgttaacgctcgtattcatttggacaacattacggcgttcaaccggattgcagaaatcgcaggtgatgaggtcgccgggatcgctgaagatgcttgcgcataccttcagaatatgtcgctggaagacgtttttacgggtgcatgttacggtgagtttatctgtcagaaagatattgaccgttataataacatctgcggcgtcatcaaccagcatatgaatcaatattgccaaaataaaaagattagccgttccaagttcaaaatggagcgtcttcacaaacaaatcctgtgccggagcgaatcaggtttcgaaattccgattggcttccaaacagatggtgaagtgattgacgctattaactcattcagcaccatcttggaagaaaaggatattctcgatcgccttcggacgttgtctcaggaagtgactggttacgacatggaacggatctatgtttcatctaaagctttcgagagtgtatcgaagtatatcgatcataaatgggatgttatcgcatcgtccatgtacaattactttagcggggctgtccgcggcaaggacgataaaaaggatgtcaagatccagacggagattaaaaagattaaatcgtgctctttgctggatttgaaaaagcttgtggatatgtattataaaatggacggtatgtgcctggaacatgaggcaactgagtatgtggcagggatcactgagattctcgtcgacttcaattacaaaaccttcgatatggacgattctgttaagatgatccaaaatgagcatatgatcaatgagattaaagaatatcttgacacatacatgtcaatctaccattgggctaaagacttcatgatcgacgagcttgtggaccgggacatggaattttatagcgaactcgatgagatctattatgaccttagtgatattgtcccattgtataataaggtccggaattacgtaactcaaaaaccttattcacaagataaaatcaagttgaactttgggagcccaaccttggcgaatggttggagtaagagtaaagagttcgacaataacgtcgtcgtcttgctccgtgatgaaaaaatttacttagctattttaaacgttgggaataagccttctaaggatattatggctggggaagaccggcgccgttcagacaccgactacaaaaagatgaattactatctccttccaggggctagtaaaactctcccgcacgtgttcatttcgtcaaacgcctggaagaaatcccatggcatcccagatgagattatgtatgggtacaaccagaataaacatctgaaaagctcgccaaattttgacttggaattttgccgcaaattaatcgattactacaaagaatgcattgactcgtacccgaattatcagatttttaacttcaaattcgcagctaccgagacatataacgacatttcagagttctataaagacgtcgaacggcaaggttacaaaatcgaatggagctatattagtgaagacgacatcaaccagatggaccgcgacggccaaatctatttgttccagatctataataaagacttcgcacctaattcgaaaggcatgcaaaacctccatacactgtatcttaaaaacatcttcagcgaagagaatctctcagacgttgtaattaaacttaacggtgaagctgaacttttctttcggaagtcttcgatccaacataaacgtggccacaaaaagggttccgtgctcgtcaataaaacgtacaagactactgagaaaacggagaatgggcagggggaaattgaggtcatcgaaagcgttccagatcaatgttaccttgaactcgtgaaatattggtctgagggcggggtaggtcagctgagcgaagaagcctcgaaatataaggataaagtgagtcattacgctgccaccatggacatcgtgaaggaccgccgttacacggaggataagttctttattcacatgccgattaccattaacttcaaggccgacaatcggaataacgtaaacgagaaggtcctgaagtttatcgcggaaaacgacgacttacacgtcattggcattgatcggggtgagcggaatctgttatatgtgtcagttatcgactcacgtgggcggattgtggaacagaaaagctttaacatcgtggaaaactacgagtcctcaaaaaatgtgatccgccgccatgattaccgtggcaagctggttaacaaagagcactaccgcaatgaagcccgtaagagctggaaagaaattggtaaaatcaaggaaatcaaagaagggtatctgtcccaggtaattcacgagattagtaaattggtattgaagtacaatgcaatcattgtgatggaggatttaaattatgggttcaaacggggccgttttaaggtggagcgccaagtttatcagaagttcgaaaccatgctcattaacaagttggcctatctcgtcgataagtctcgggcggtagatgagccaggcgggcttttaaaaggctatcaattaacctacgtaccggacaatctcggcgaactcggtagtcaatgcggtattattttctacgtaccagcggcgtacacctcgaaaatcgatcctgtcacaggcttcgtggatgtattcgactttaaagcttatagtaatgcggaagcacgtttagattttattaataaacttgattgtatccgttatgatgctccacgcaataaatttgaaattgcctttgactatgggaacttccggacgcatcacacgacccttgccaaaacgagctggaccatcttcatccatggggaccggatcaaaaaggagcgcggtagctatggttggaaagatgagattatcgatatcgaggctcgcattcgcaagctgtttgaagatacagatattgaatatgctgacgggcataatctgatcggcgacatcaatgaattggagtcacctatccagaaaaagtttgtcggggagctcttcgacatcattcgcttcacggtacaattacggaattcgaaatccgagaagtatgatggcactgagaaagagtatgacaaaattatctcgccggtgatggacgaggaaggggtgttctttacaacggatagctatattcgtgccgatggcacggaattgccaaaagatgcagatgcaaatggtgcctattgcattgctctgaagggtttatatgacgtcttggcggttaaaaaatactggaaagagggggagaagttcgaccggaaactcctcgccattacgaactacaattggttcgattttatccaaaaccggcggttcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1100 - DNA, 4110 bp, synthetic construct
  misc_feature 1..4110: note = Description of Artificial Sequence: Synthetic polynucleotide
  source 1..4110: mol_type = other DNA
atgggccaccatcatcatcatcatagcagcggcctggtgccgcgcggcagcggtaccatgtgttatgacctcaataacattaagactaagcttcgggaacgggaagtcgagactatgggtaacaacatggacaactcgtttgagccgttcattgggggcaattctgtctcgaagacgttacggaatgaattacgcgtaggtagtgagtacacgggtaagcatattaaagaatgtgcgattatcgcggaggacgccgtgaaggcggaaaatcagtacattgtgaaggagatgatggatgacttctaccgcgatttcatcaaccggaagttggatgccctccaggggatcaactgggaacagctgtttgatattatgaaaaaagctaaactcgacaaaagtaataaagtatccaaagaattagataagattcaagaaagcacccgcaaagagattggcaagattttctcgagtgatcctatttacaaggatatgttaaaagctgatatgatcagcaaaattctcccggaatacattgtggataaatatggtgacgcagcatcccgcatcgaggcagtcaaagtattctatggtttctcgggctatttcattgacttctgggctagccgcaaaaatgtattttccgacaagaatatcgccagcgcgatcccacatcgcattgtaaatgtcaacgctcgtattcatcttgataatatcacagctttcaaccgcatcgcagagatcgcaggggatgaggtcgccggcatcgctgaagacgcctgcgcttacttgcagaatatgtcccttgaggacgttttcaccggtgcctgctatggggaattcatctgccagaaagatattgatcgctataataatatttgtggtgtaatcaatcaacatatgaaccaatactgccaaaataagaagatcagtcgttcgaaattcaaaatggaacggctgcataagcaaatcctctgccgctcagagtctggtttcgaaatccctatcggttttcaaacggatggggaagttatcgacgcgatcaatagcttttctacgatcttggaggaaaaggatattctcgatcggttgcgcacgctgtctcaagaggtgacgggttacgatatggagcgtatctatgtttcttcaaaggccttcgaaagtgttagcaagtacatcgaccacaagtgggacgtgattgcctctagcatgtacaactatttctccggggcggtccggggcaaggatgataaaaaagatgtgaagattcaaactgaaattaagaaaattaaatcctgctctctcctcgatttgaagaaactcgtcgacatgtattataagatggatggcatgtgtcttgagcatgaggccactgagtacgttgcagggatcactgaaattttggtcgatttcaactacaagacttttgatatggatgattccgtcaagatgatccaaaacgagcatatgattaacgaaattaaagaatacctggacacatatatgtcgatttatcattgggccaaagacttcatgattgacgagctcgtggaccgtgacatggagttttactccgagttagatgagatctactacgacctctcagatattgttccattatacaacaaagttcgcaattacgtcacgcagaagccttactcacaagataaaatcaaactcaacttcgggtctccaacattggccaacggctggtccaagtcgaaagagtttgacaataatgtagtagtgctgctccgggatgagaaaatttatctcgcgatcttaaacgtaggtaacaagccgtctaaggacattatggccggcgaggaccgccgccgttcagacacagattacaagaagatgaactattatcttttaccaggggcaagtaagacacttcctcatgttttcatttcgtctaatgcgtggaaaaaaagccatggcatcccagacgaaatcatgtatggttataaccaaaataagcatctcaaatcgtcgccgaacttcgatctggaattttgccgcaaattaattgactactataaagagtgcatcgatagctacccaaactaccagattttcaactttaaattcgctgcgacagagacgtacaacgatattagtgagttctataaagacgtggaacgccagggttataaaattgaatggagctatatctccgaggatgatatcaatcagatggatcgcgacggccaaatttatctcttccaaatttacaacaaagatttcgcacctaactcaaagggcatgcagaatcttcacacgctttaccttaagaatatcttcagcgaagaaaatctttccgacgtcgtgatcaagcttaatggcgaggcagaacttttttttcggaaatctagcatccaacacaagcgtggccacaaaaaaggtagtgtgttagtaaacaaaacctacaagacgacggaaaaaaccgagaacgggcaaggcgagattgaggtaatcgaatcggtacctgatcagtgctacctcgagcttgtaaaatattggtcggagggcggggtggggcagttatccgaggaggcctccaaatataaagacaaagtttcgcattatgccgcaactatggacattgttaaagatcgtcgctacacagaggataagttctttattcacatgcctatcactattaattttaaggctgataaccgcaacaatgttaatgaaaaggtgctgaaatttatcgcggaaaatgacgacttgcatgtcattggcatcgaccgtggcgaacgcaatcttctctatgtatctgttattgactcgcgggggcggatcgtggagcaaaaatctttcaatatcgtcgaaaactacgagtcatcaaaaaacgtgattcggcggcatgattaccgcggtaagctggtaaataaggaacactatcgcaatgaagcacgtaaatcctggaaagaaatcggcaaaattaaagagattaaagagggctatctttcgcaagtaattcacgaaatcagtaagctcgtattgaagtacaatgcgatcatcgtaatggaggacttaaactatggttttaaacggggccgtttcaaagtggagcgccaagtttatcaaaagttcgagacaatgcttatcaataaattggcttatctggttgataaaagtcgcgctgttgatgagccaggtggccttctgaaaggctatcagttgacctatgtgcctgataacttaggtgagcttgggtctcagtgcgggatcattttctacgtcccagcggcctatacgtcgaagattgacccggtgacggggtttgtagacgtgtttgatttcaaagcgtactcgaacgctgaagctcgcttggatttcattaacaagctggactgcatccggtacgatgctccacggaacaagttcgaaatcgcattcgattatggcaattttcgcacgcatcatacaaccttagctaaaacaagctggacaatctttatccatggggatcgcattaaaaaagaacgcggtagttacggttggaaagacgaaatcatcgacattgaggctcgcattcgtaaactcttcgaagataccgatattgaatatgcggatgggcacaatctgatcggtgacatcaatgaactcgaaagtcctattcagaagaaattcgtgggggaactttttgacattatccgctttactgtacagttacgcaattccaagagcgaaaagtatgacggcaccgagaaagagtacgataaaattatctcgcctgtgatggatgaggaaggggttttcttcactacggactcatatatccgcgctgacggcacggagttgcctaaggacgctgatgccaatggcgcgtactgtatcgctctcaaggggctttatgatgtacttgccgtaaaaaaatactggaaggaaggggagaagtttgaccgtaagttgttggccattactaactacaattggtttgatttcatccagaaccgtcgtttcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1101 - DNA, 4110 bp, synthetic construct
  misc_feature 1..4110: note = Description of Artificial Sequence: Synthetic polynucleotide
  source 1..4110: mol_type = other DNA
atgggccaccatcatcatcatcatagcagcggcctggtgccgcgcggcagcggtaccatgtgctatgatctcaacaacatcaaaacaaagcttcgggaacgggaagtagagactatgggcaataacatggataactcttttgaaccattcattgggggtaactccgtttctaagactctccgcaacgagttacgcgtaggctctgagtacaccgggaaacacattaaggagtgcgctattatcgccgaggatgctgtgaaagccgaaaaccagtatattgttaaagagatgatggacgatttctaccgtgacttcattaaccggaaacttgacgcccttcaggggatcaactgggagcaattattcgatattatgaaaaaggcaaagcttgataaaagcaacaaggtttcaaaagaattagataaaattcaggaatccacccgtaaggaaattggcaagattttctcatcggatcctatctacaaagatatgctcaaagccgatatgatctccaaaattctgccagaatacatcgtagacaagtatggcgatgctgcgtcccgcattgaggcggttaaagtcttctatggcttttctgggtatttcatcgatttctgggcatctcgtaaaaatgtttttagcgacaagaatatcgcttccgccattccgcatcgtattgtgaacgttaatgctcgcattcatttagataatattactgcgtttaatcgtatcgcagagatcgcgggggatgaagtggcagggattgcggaagacgcatgcgcctacttgcaaaatatgtcattagaagacgtttttacgggtgcctgctacggtgagttcatctgtcaaaaagatatcgatcgttacaataacatctgcggtgtaattaaccaacatatgaaccagtactgccaaaataagaaaattagccgttcaaaattcaagatggaacgcctccacaagcagatcctgtgtcggtctgagtccggcttcgaaattccgatcggctttcagactgatggggaagtgattgacgctatcaactcattttcgacaattctcgaggaaaaggacatcctcgatcgcttacgtactttatctcaagaagttaccgggtatgatatggaacgcatttatgtatcgagcaaggccttcgagagcgtctcgaaatatatcgaccataagtgggacgtaatcgcatcgtctatgtacaattacttctccggcgcagtgcgcggtaaggatgataaaaaagacgtaaaaatccaaactgagatcaagaaaattaagagttgtagtctcctcgacctcaaaaaattggtggatatgtattataaaatggatgggatgtgcctcgaacacgaagccacagagtacgtcgcaggcatcaccgaaatcctcgtagatttcaactataagacgttcgatatggatgactccgtcaagatgatccagaacgaacacatgattaacgagatcaaggagtacctcgatacctatatgagcatttaccactgggctaaggatttcatgatcgatgagcttgtcgaccgggacatggaattttattctgaacttgatgaaatctactatgacttgagcgatattgtaccactttataacaaggtgcgtaattatgtcacccaaaagccgtactcccaggataaaatcaaacttaactttggttcaccaacgttggccaatggttggtccaaatcaaaggaattcgataacaatgtagtggttctcctccgggacgaaaagatttatctcgcaatccttaacgtgggtaacaaaccgtctaaggacattatggctggggaggatcgtcgccggagcgacacagactacaaaaagatgaattattatttactcccgggtgcgtccaagaccttgccacatgttttcatcagttctaacgcatggaagaagtcacacggtatcccggatgaaattatgtatgggtataaccagaacaaacatctcaaaagtagtcctaatttcgacttggagttctgtcggaaactgatcgattactacaaggaatgcatcgattcttatccaaattatcagatcttcaatttcaagtttgccgccacagaaacgtataacgatatctccgaattctacaaagatgtcgagcgccaggggtacaagatcgagtggtcttatatttcggaggatgatattaaccagatggaccgtgatggccagatttaccttttccagatctacaacaaagattttgccccgaacagtaaaggcatgcaaaacctccataccttatacttaaagaatatcttctcggaggaaaatttgtcggacgtagtcattaaattgaatggtgaggctgaattattcttccggaagtcttcgatccagcacaaacgcgggcacaagaaaggctcagtcttggtaaataaaacttataaaacaacggaaaagacggagaatggccagggcgaaattgaagtgatcgagtcggtcccagaccaatgctacttggaactcgttaagtactggtctgaaggtggggtcgggcagctgtcggaggaggcatcgaagtacaaggacaaagtgagccactacgcggccacgatggacattgtaaaggatcgtcggtatacagaagacaaattctttattcatatgcctatcacaattaactttaaagcggacaatcgtaataacgtgaatgaaaaagtattgaaattcattgcagaaaacgacgacttgcatgtaattggtatcgaccgcggtgagcgcaacctcctttacgttagcgtgatcgattcacgtgggcgtattgtggagcaaaagtcgttcaatattgtcgagaactatgaatcaagtaaaaatgtaatccggcggcatgattaccggggtaagcttgtcaacaaggaacattaccgtaatgaggcccgcaagtcatggaaagaaatcggcaagattaaggagatcaaggaaggttatctcagtcaagtaatccacgaaatctccaagctcgtactcaaatataatgcaatcattgtaatggaagatttgaattacggttttaagcggggtcgcttcaaagtcgagcgccaagtttaccaaaaattcgagacaatgctgatcaataaattggcttacttagtggataaaagtcgtgctgttgacgagcctggtggtcttttgaaggggtatcagttgacgtatgtgcctgacaatcttggggagctgggttctcagtgcggtattattttttacgtgccggcagcatatacttcgaaaatcgaccctgttaccggtttcgtcgatgtattcgactttaaagcgtattccaatgccgaggcccgtctggactttatcaacaaacttgactgtattcgttacgatgcgcctcggaataaattcgagattgcgtttgactatgggaattttcggacgcatcataccacgttagccaagacgtcttggactatttttatccatggcgatcgcattaaaaaggaacgcggttcatacggctggaaagatgagatcatcgatatcgaagctcgcatccggaagcttttcgaagacaccgacatcgaatatgcagacgggcacaacttgattggtgatatcaatgaactggaatcccctattcaaaaaaaattcgtgggtgagttgttcgacatcatccggtttacggtccagttacggaactcgaagagtgagaaatacgatggtactgagaaagagtatgacaagatcatctctccagttatggatgaggagggcgtattttttactacggactcatacatccgcgcggacggtacggaattaccgaaggatgccgatgcaaatggcgcatactgtatcgcacttaagggcctctacgacgttttagctgtgaagaaatactggaaggagggcgaaaaatttgaccgcaagttattagctattacgaattacaactggttcgattttattcaaaatcgtcggttcggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1102 - DNA, 4110 bp, synthetic construct
  misc_feature 1..4110: note = Description of Artificial Sequence: Synthetic polynucleotide
  source 1..4110: mol_type = other DNA
atgggccaccatcatcatcatcatagcagcggcctggtgccgcgcggcagcggtaccatgtgctatgatttaaataacatcaaaacgaagctgcgggaacgcgaagtcgagacaatgggcaacaatatggataattcttttgagccattcattggcggtaactccgtgtctaaaaccttacgtaacgagcttcgggtagggagtgagtatactgggaaacacattaaagagtgcgcgatcattgcggaagacgcggtaaaagccgaaaatcagtatatcgtcaaggagatgatggatgacttctaccgtgatttcattaaccggaagctcgatgccctgcagggcattaattgggagcaattatttgatatcatgaaaaaagcaaagttggacaaatcaaacaaagtcagtaaagagctcgacaaaatccaagagtccacccgcaaggaaatcggtaagatttttagctccgatcctatctataaagacatgctgaaagccgacatgatctcaaagattttgccggagtatattgtcgacaaatatggcgacgcagcttctcgtatcgaagctgttaaagttttttacggtttctctgggtattttattgatttttgggcaagtcgcaaaaacgttttttcggataaaaatattgcatcggcaatccctcatcggatcgttaacgtaaatgcccggatccacttggacaacattacggcttttaatcgcatcgccgaaattgccggcgatgaagttgcgggcattgccgaggatgcgtgtgcctacttacaaaacatgtctttagaggatgtgtttactggtgcttgctacggtgagtttatttgccaaaaagatattgaccgttacaacaatatctgtggggtcatcaaccaacacatgaaccaatattgtcagaataagaagattagccggtcgaaattcaaaatggaacgcctccacaaacaaatcctttgtcgcagtgagagcggcttcgagattccgatcgggttccaaaccgacggcgaagtgatcgatgcgattaacagtttttctactatcttggaagagaaggacatcctggaccggttacgcacgctttcccaggaagtcacgggctatgacatggaacggatttacgtatcaagtaaggcattcgaaagcgtgtcaaagtacattgaccataaatgggacgtgattgcgagtagcatgtacaattatttttcgggggctgtgcgtgggaaagatgataaaaaggatgttaagatccagactgagattaaaaaaatcaagtcctgttcgttattagaccttaagaaattagtcgacatgtattacaaaatggacgggatgtgcctcgagcacgaagctactgagtacgtagctggcatcaccgaaattttagttgactttaattataaaacattcgacatggatgattccgtaaagatgatccagaatgaacatatgatcaatgaaattaaggagtatttggatacatatatgagcatttatcattgggcgaaggatttcatgattgacgaactggtggatcgggacatggaattctatagcgaattggacgagatttattacgatttatctgacatcgtccctttgtataacaaagttcgtaactacgtgacccaaaagccgtattcgcaagataagatcaagttgaattttggttctcctaccttagcaaatggctggtctaaatctaaggaattcgacaacaatgtggtggtattgctccgcgatgagaagatttatcttgcaatcctgaacgtcgggaacaaaccgtcgaaggacattatggcgggggaggaccggcgccgctccgacacagattataagaagatgaactattatctgttacctggtgcctccaaaacactgccgcacgtatttatcagctctaacgcgtggaagaaatcacacgggatcccggatgagatcatgtatggttataaccaaaacaaacacttaaagagtagccctaacttcgacttagaattctgccggaagttaatcgactattacaaagagtgcattgactcatatcctaattaccaaattttcaactttaagtttgcggccacagagacctacaacgacatcagtgagttctacaaagacgtcgagcgccaaggctataagattgagtggagttatatcagtgaagacgacatcaatcagatggatcgcgacggccagatttatttattccagatttacaacaaagacttcgcaccaaactctaaaggcatgcaaaaccttcacacgctctatcttaagaatattttttctgaagagaacctgagtgacgtggtgattaagttgaacggtgaagcggaattgttctttcggaaatcgagtatccaacacaagcgcggccacaaaaaaggcagcgttcttgtcaacaaaacttataagactaccgagaagactgaaaatggtcaaggcgagattgaagtaattgaatcggttcctgaccaatgctatctcgagttagtaaaatactggtctgaggggggggtcggccaactgagtgaagaggcaagcaaatacaaggacaaggtctcgcactacgcagccactatggatatcgtaaaagaccgccggtatacggaggacaaatttttcattcatatgccaatcacgattaactttaaggcagataaccgtaacaacgtgaatgaaaaagtgcttaaatttatcgctgagaacgacgacctgcacgttatcgggattgaccgcggtgaacggaatctcctttacgttagtgtcattgactcccgcggccgcatcgttgaacaaaagtcattcaatatcgttgagaactacgagtctagtaagaatgtgatccgccggcatgattaccgcggtaaattagtgaacaaggagcattatcgcaatgaagcccgtaagagttggaaagaaatcgggaagattaaagagatcaaagaagggtacttgtcacaggttattcacgaaatctctaagttggttttaaaatataacgcaatcatcgtaatggaggatcttaactacgggtttaaacgcgggcgcttcaaagtggaacgccaggtgtatcagaaattcgaaacgatgttgatcaataagttggcatatcttgtagataagagccgggctgtcgacgaaccaggcggcctcctgaaaggttaccagttaacatatgtgccggacaatttgggcgaattgggttcacagtgtgggatcatcttctacgttccggccgcatacacgagcaaaatcgatccagtcaccgggtttgtcgacgtctttgacttcaaagcctatagtaacgccgaagcccgcctcgacttcatcaataaattagactgcatccggtatgacgcgcctcggaataaattcgaaattgctttcgactatgggaacttccgcacccaccacacaacgttagctaagacgagttggacaatctttattcatggtgaccgcatcaagaaagaacgcggctcatacggctggaaggatgaaatcattgacatcgaggcgcgcatccggaagctgttcgaggataccgatattgagtacgcggatggccataatctcatcggggatatcaacgagctcgaatctccgattcagaaaaaatttgttggggaactctttgatattattcggtttacagtgcaattgcggaacagcaagagtgaaaaatacgacgggacggaaaaggaatacgacaagatcatcagtcctgtaatggacgaggaaggtgtcttctttaccactgattcttacatccgcgccgacggcacagagctcccgaaggacgcagacgcgaacggtgcgtactgcatcgcgttaaaaggcctgtatgacgtgctcgctgtcaaaaaatactggaaggaaggggaaaaatttgatcggaaacttttagcaatcactaactacaactggttcgactttatccagaaccggcgctttggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1103 - protein, 1463 aa, synthetic construct
  REGION 1..1463: note = Description of Artificial Sequence: Synthetic Cas12a/Cpf1 [Catenovulum sp. CCB-QB4] sequence
MSDRLDVLTNQYPLSKTLRFELKPVGATADWIRKHNVIRYHNGKLVGKDAIRFQNYKYLKKMLDEMHRLFLQQALVLEPNSNQAQELTALLRAIENNYCNNNDLLAGDYPSLSTDKTIKISNGLSKLTTDLFDKKFEDWAYQYKEDMPNFWRQDIAELEQKLQVSANAKDQKFYKGIIKKLKNKIQKSELKAETHKGLYSPTESLQLLEWLVRRGDIKLTYLEIGKENEKLNELVPLVELKDIHRNFNNFATYLSGFSKNRENVYSTKFDRRSGYKATSVIARTFEQNLMFCLGNIAKWHKVTEFINQANNYELLQEHGIDWNKQIAALEHKLDVCLAEFFALNNFSQTLAQQGIEKYNQVLAGIAEIAGQPKTQGLNELINLARQKLSAKRSQLPTLQLLYKQILSKGDKPFIDDFKSDQELIAELNEFVSSQIHGEHGAIKLINHELESFINEARAAQQQIYVPKDKLTELSLLLTGSWQAINQWRYKLFDQKQLDKQQKQYSFSLAQVERWLATEVEQQNFYQTEKERQQHKDTQPANVTTSSDGHSILTAFEQQVQTLLTNICVAAEKYRQLSDNLTAIDKQRESESSKGFEQIAVIKTLLDACNELNHFLARFTVNKKDKLPEDRAEFWYEKLQAYIDAFPIYELYNKVRNYLSKKPFSTEKVKINFDNSHFLSGWTADYERHSALLFKFNENYLLGVVNENLSSEEEEKLKLVGGEEHAKRFIYDFQKIDNSNPPRVFIRSKGSSFAPAVEKYQLPIGDIIDIYDQGKFKTEHKKKNEAEFKDSLVRLIDYFKLGFSRHDSYKHYPFKWKASHQYSDIAEFYAHTASFCYTLKEENINFNVLRELSSAGKVYLFEIYNKDFSKNKRGQGRDNLHTSYWKLLFSAENLKDVVLKLNGQAEIFYRPASLAETKAYTHKKGEVLKHKAYSKVWEALDSPIGTRLSWDDALKIPSITEKTNHNNQRVVQYNGQEIGRKAEFAIIKNRRYSVDKFLFHCPITLNFKANGQDNINARVNQFLANNKKINIIGIDRGEKHLLYISVINQQGEVLHQESFNTITNSYQTANGEKRQVVTDYHQKLDMSEDKRDKARKSWSTIENIKELKAGYLSHVVHRLAQLIIEFNAIVALEDLNHGFKRGRFKIEKQVYQKFEKALIDKLSYLAFKDRTSCLETGHYLNAFQLTSKFKGFNNLGKQSGILFYVNADYTSTTDPLTGYIKNVYKTYSSVKDSTEFWQRFNSIRYIASENRFEFSYDLADLKQKSLESKTKQTPLAKTQWTVSSHVTRSYYNQQTKQHELFEVTARIQQLLSKAEISYQHQNDLIPALASCQSKALHKELIWLFNSILTMRVTDSSKPSATSENDFILSPVAPYFDSRNLNKQLPENGDANGAYNIARKGIMLLERIGDFVPEGNKKYPDLLIRNNDWQNFVQRPEMVNKQKKKLVKLKTEYSNGSLFNDLAFK

SEQ ID NO: 1104 - DNA, 4392 bp, synthetic construct
  misc_feature 1..4392: note = Description of Artificial Sequence: Synthetic Cas12a/Cpf1 [Catenovulum sp. CCB-QB4] sequence
  source 1..4392: mol_type = other DNA
atgagtgatcgtctagatgttttaaccaaccaatatccactatctaaaacgttgcgtttcgaattaaagccagttggcgcaacagcagattggattcgcaagcacaatgttatccgttatcataacggtaagttggttggcaaagatgcgattcgctttcaaaactacaagtatcttaaaaagatgcttgatgaaatgcatcgcttgtttttacaacaagctttagtgctagagccaaatagcaatcaagcgcaagaacttaccgcattattgcgcgctatcgagaataactattgtaataacaatgacctactggcaggagactatccgtcattaagcactgataaaaccattaaaatatcaaacgggttaagtaaattaacgactgacttattcgataaaaagtttgaagattgggcttaccaatataaagaggatatgcctaatttttggcgccaagacattgcagagcttgaacaaaagttacaagtttcagctaacgctaaagatcaaaaattctataaaggtataattaaaaagctcaaaaataaaattcaaaagagcgagttgaaagctgaaacccataaaggattatactcgcctacagaaagcttacagctgctagagtggctagtcagacgaggtgatattaaattaacctatttggaaataggtaaggagaatgaaaagctaaacgagttagtaccattagttgaattgaaggacatacatcgtaacttcaataattttgcgacctatcttagtggctttagtaaaaaccgagagaatgtttactcaactaagtttgataggcgaagcggttacaaagcaacatctgttattgcgcgaacgtttgaacaaaacttaatgttttgtcttggcaatattgctaagtggcataaggttacagaatttattaaccaagcgaataattatgagctattgcaagaacatggcattgactggaacaagcaaattgccgcattagaacacaagttagatgtatgtcttgccgaattttttgcactaaacaacttcagtcaaactttggctcaacagggcattgaaaaatataaccaagtgttagcgggtattgctgaaatagcaggacagcctaaaacacaaggtttaaacgaattaattaaccttgcccgacaaaaattatcagctaagcgttcacaactgccaacgttgcaacttctatacaaacaaattcttagcaaaggtgataagccatttattgatgattttaaatcagaccaagagttgatcgccgagttaaatgaatttgttagtagtcagatccacggtgagcacggcgcgattaaattaatcaatcatgagttagaaagctttatcaatgaagccagagcagcacagcaacaaatatatgtgccaaaagataagttaactgagttgtcgttgttactgactggatcttggcaggccattaaccaatggcgttacaagctatttgaccaaaagcagttggataaacagcaaaagcaatattctttttcgttagcacaggtagaacgatggctcgcgactgaggtagagcaacagaacttctatcaaacagaaaaggaacgccagcagcacaaggatacacagccagccaatgtaactacaagtagtgacggtcattctattttgactgcgtttgagcagcaggtgcaaacgttattaaccaatatttgcgtggctgctgaaaaatatcgccagttaagtgataacttaacggccatagacaaacagcgagaaagtgagtcgagtaaagggtttgagcaaatcgccgttattaaaacgttactcgatgcctgcaatgaactaaatcactttttagcccgttttacggttaacaaaaaagataaattaccggaagatagagctgagttttggtacgaaaaactgcaagcttatattgatgctttccctatctatgagctttacaacaaggttagaaactacctttcgaaaaagccattttcgaccgaaaaagtaaaaattaattttgataatagccattttttatccggttggactgctgattatgaaaggcactctgctctgctatttaaatttaatgaaaattatttacttggcgtagtaaacgaaaaccttagcagtgaagaagaggagaaacttaaattagttggaggggaggaacatgcgaagcgatttatttatgattttcaaaaaatagataactcaaacccaccaagagtatttataagatcgaaaggtagttcatttgctccagcggttgaaaaatatcaattgccaattggtgacataatcgatatttacgatcaaggtaaatttaaaactgagcataagaaaaaaaatgaggccgagtttaaggacagcctggttaggctaattgattattttaagctaggttttagtcgccatgattcgtataagcattacccatttaaatggaaagccagtcatcaatattctgatatcgcagaattctatgctcatactgcaagcttttgctacacactaaaagaagaaaacataaattttaacgtgttgagggagttatcaagtgcaggaaaagtttatttatttgaaatttacaacaaagacttttctaaaaataaacgaggtcaggggcgagataacttacacaccagttactggaagctgctatttagcgcagaaaacctcaaagacgtagttctaaagctgaatgggcaagcggaaattttttacagacctgcaagtctcgctgaaactaaagcatacacccataaaaaaggcgaagttttgaaacacaaagcttacagcaaagtatgggaagctttagattctccaataggaactcgattaagctgggatgatgctttaaaaataccttctatcactgaaaaaacgaatcataataatcagagggtagttcaatataatggtcaagaaatcgggcgaaaagcagagttcgcgatcataaaaaatcgccgctattcggtagacaagtttttatttcattgtccaatcaccttaaatttcaaggcgaatgggcaagacaatatcaatgcccgtgttaatcagtttttagcgaataataaaaaaatcaacattattggtattgatcggggtgaaaagcacttactgtatatttctgttattaatcaacaaggtgaagtgctgcaccaagagtcgtttaataccatcaccaacagttatcaaacagctaacggtgaaaagcgccaagtagtcacagactatcaccaaaagcttgatatgagtgaagataagcgtgacaaagcccgaaaatcttggtcgacaatcgaaaatataaaagaactcaaggctggctatttgtcgcatgttgtccatcgactagcacaattgattattgagtttaatgccattgttgcgctcgaagatttaaatcatgggtttaagcgtgggcgatttaaaattgaaaaacaggtttatcaaaaatttgaaaaagcgcttatcgataagcttagctaccttgcgtttaaagacaggacttcctgtttagaaacaggccattatctcaatgcgtttcagctaactagtaaatttaaagggtttaataacctcggtaaacagtcgggcattttgttctatgtgaatgccgattacacctcaaccactgatccactaacgggctatattaaaaacgtttataaaacctatagcagcgtcaaagacagtactgaattttggcagcggtttaatagtattcgctatatcgcaagcgagaatcgatttgaatttagctacgacttagctgatctcaaacaaaaatcattagagagtaaaaccaagcaaacacctcttgcgaaaacacaatggacagtgagtagtcacgtgactcgctcgtactataaccaacaaactaaacagcatgagctgtttgaagtaacagctcggatacaacaattgcttagcaaagccgaaataagttaccagcaccaaaacgatttaattcctgctttagccagttgccaatctaaagcgctacataaagagcttatttggctatttaacagcattttgacaatgcgcgtgacagacagcagcaagccatcggcaaccagcgaaaacgactttattttatcgccagtcgcgccttactttgatagcagaaacttaaataaacaactgccagaaaatggtgatgctaatggcgcgtataacatagcgcgtaaaggcatcatgctgttagaaaggattggtgattttgtgccagaaggtaataaaaaatatccagatttactgatccgcaataatgattggcagaactttgttcagcgaccagagatggtcaataagcaaaagaaaaaactggttaaattaaagacggaatacagcaatggaagcttatttaatgatctcgcatttaaatga

SEQ ID NO: 1105 - DNA, 4581 bp, synthetic construct
  misc_feature 1..4581: note = Description of Artificial Sequence: Synthetic polynucleotide
  source 1..4581: mol_type = other DNA
atgggccaccatcatcatcatcatagcagcggcctggtgccgcgcggcagcggtaccatgtcggatcgtcttgatgtacttacaaatcaataccctctcagtaaaactttacggttcgagctgaagccagttggggcgaccgctgattggattcgtaaacacaatgtaatccgttatcacaatggtaagttagtgggcaaagacgccattcgctttcagaactataagtacctgaagaaaatgcttgacgagatgcaccggctgtttttgcagcaagcacttgtattagagcctaattcaaaccaggcccaggaactcaccgccctcttacgcgcaatcgagaacaattattgcaacaacaatgatttactggcgggtgactacccttctctctcaacagacaagactattaaaatttcaaacggtttatcaaaattaaccactgatctctttgacaaaaagttcgaagactgggcgtatcaatataaagaagacatgcctaacttttggcgtcaagacattgcggagcttgagcagaaactgcaggtttcggcgaacgctaaagatcagaagttttataaagggattatcaaaaaacttaagaataaaattcagaagtcggaactcaaggccgaaacccacaagggtctttattcaccgacggagtctctccagttactggagtggcttgtacgtcgtggcgacatcaagttgacctatttagagattggtaaggagaacgagaaattgaatgagttagtaccactggtagagctgaaggacatccatcggaactttaacaatttcgccacatacctttctgggttctcgaaaaaccgcgagaatgtttactccacaaagttcgaccggcggagcggctacaaggctacatccgttatcgctcggacattcgagcaaaaccttatgttctgtctcgggaacatcgccaaatggcacaaggttacggaatttatcaaccaggcgaacaactacgaacttcttcaggagcacggtattgattggaacaaacaaatcgcggccttagagcataagttagacgtttgtctcgcagagtttttcgcgctcaataatttttcgcaaacattagcccaacaaggcatcgagaaatacaatcaggtcttggctggtatcgcggaaatcgccggtcaaccgaagacccagggcttgaacgagctcatcaatttagcgcgtcaaaagctgtcggccaaacggtcgcagctcccaacgttgcagttgctctacaaacagatcttgtcaaaaggcgacaagccattcatcgacgatttcaagagcgaccaggaattgattgcggaacttaacgagttcgtctcatcgcaaattcacggggagcatggcgcaattaaactcatcaaccacgagttagaaagtttcattaatgaagcccgtgccgcgcaacagcagatctatgtacctaaagataagcttactgaattatcattgctcttgacgggttcctggcaggctattaatcaatggcggtacaagttatttgaccaaaagcagttagacaagcaacagaaacaatactctttttcgctggcgcaggtggagcgctggttggcgacggaggtggagcagcagaacttttatcagacggagaaagagcgccaacaacataaagacacgcagccagctaacgtcactacgagttctgatggccatagtattcttactgctttcgagcaacaagttcagaccttacttacgaatatctgcgtcgcggccgagaaatatcgtcagttatcagataacctcaccgcgatcgacaagcagcgggagtccgagtcgagtaagggtttcgaacaaattgcggtcattaagacactcttagacgcttgcaacgaacttaatcatttcctggctcggttcacggtcaacaagaaggataaattaccggaggaccgcgctgagttttggtacgagaaactccaggcttacatcgatgccttccctatttatgaactctataacaaggtccggaactacttaagtaagaagccgttctctacggaaaaagtgaaaatcaactttgacaacagccattttttatccggttggacagccgactacgaacggcactcggctctcctttttaaatttaatgaaaactatctccttggcgttgtcaatgaaaatttgagttccgaagaagaggaaaagctgaagctcgtcggcggcgaagagcatgctaagcggtttatttacgacttccagaaaattgataattccaaccctccgcgggttttcatccgtagcaaagggagctcctttgctcctgccgtcgaaaaataccagctgcctatcggggacattatcgacatctatgaccaaggcaagtttaaaacagaacacaaaaagaagaatgaagctgagttcaaggactccctggttcgcttgatcgattacttcaagctgggttttagtcggcacgacagttataagcactacccttttaaatggaaagcttctcaccagtacagcgatatcgcggaattctacgcgcatactgccagtttctgttatactttgaaggaggaaaacattaactttaatgtgctccgtgagttgagttccgcaggtaaagtgtatctctttgaaatctataacaaagatttctctaagaataagcgtgggcaagggcgggataatctccataccagctattggaagctgctcttctcggcggaaaatctcaaagacgtcgtcttaaaactgaacggtcaagccgaaatcttctaccggccagcctccctcgcagaaaccaaagcttacacccataagaaaggtgaggttctcaaacataaagcctacagcaaggtttgggaagctctggactctccgatcgggacacgtttgagctgggacgatgctctcaaaatccctagcattacggagaaaaccaatcataataaccaacgcgtggtgcaatacaacgggcaagaaatcggtcggaaggcggagttcgcaattattaagaatcgccggtactcagttgataagtttctcttccactgccctattacattgaacttcaaagctaatggccaagacaacatcaatgcccgcgtaaatcaattcctcgcgaataataagaaaattaacattatcggtatcgaccggggcgagaagcacctcttgtatatctcagtaattaatcaacagggtgaagtattgcaccaggagagctttaacacaattaccaactcgtatcagacagctaacggtgaaaagcggcaagtcgtaaccgattaccatcaaaagctggatatgtcagaagacaagcgggataaagcacggaaaagctggagtactatcgaaaatatcaaggaattgaaggcaggctatctttcacacgtagtgcatcggttagctcagttgatcattgaatttaacgcgatcgtggccttagaggacctgaaccatggctttaaacggggccgtttcaaaatcgaaaagcaagtataccagaagtttgaaaaagcactgatcgataaattgtcatatcttgcttttaaagaccggacatcgtgtttggaaaccgggcattatctgaatgcctttcagttgacctcaaaatttaagggctttaacaatctgggtaaacagtccggtatccttttctacgtaaacgcagattataccagtacgacagacccgctcaccgggtatatcaaaaatgtgtataagacttacagttcggttaaagacagtactgaattttggcagcgcttcaacagtatccggtatatcgccagcgagaatcgttttgagtttagttatgacctcgcggatcttaaacagaagagcctcgagtcgaaaacaaaacaaactccactggcaaaaacccaatggacggtcagttcacacgtaacacgtagttactacaaccagcaaacaaaacagcacgagttattcgaagtaacagcgcggatccagcaactcctgagtaaggccgaaatttcatatcaacatcaaaacgacttgattccggctcttgcatcatgccagtcgaaagctttgcacaaagagctgatttggttattcaactcgattctcactatgcgtgtaaccgactctagtaaaccttctgctacatccgagaatgatttcattttaagtcctgtcgccccatacttcgatagccgcaatctgaataaacagcttccagaaaatggtgacgcaaatggggcttataatattgcacgtaaaggcattatgttgctcgaacgcatcggcgactttgtgcctgaaggtaacaagaagtacccagatctgctcatccggaacaacgattggcaaaatttcgtccagcgcccggaaatggttaacaaacaaaaaaaaaaattggttaagttaaaaacggagtactcaaatggctcgctgttcaatgatttagcgttcaaaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1106 - DNA, 4581 bp, synthetic construct
  misc_feature 1..4581: note = Description of Artificial Sequence: Synthetic polynucleotide
  source 1..4581: mol_type = other DNA
atgggccaccatcatcatcatcatagcagcggcctggtgccgcgcggcagcggtaccatgtctgaccggcttgacgtactcactaatcaatacccattgagtaaaaccctgcgtttcgagctcaagcctgttggggcgaccgcagattggattcgcaaacacaacgttattcgctatcacaatggtaaactggtcgggaaagatgcaattcggtttcagaattacaagtacctcaaaaagatgctggatgagatgcatcggttattccttcaacaggccctggttttggagccaaactcaaaccaagcgcaggaactgacagcgctgcttcgcgcaatcgagaacaattattgcaataataacgacttgctcgcgggtgactatccttctcttagtacagataagacaattaaaatttcaaatgggttgagcaagttgacgacagatctgtttgataaaaagtttgaagactgggcgtaccagtacaaagaggatatgcctaacttttggcgccaagacattgctgaattggaacagaagttgcaagtatccgccaatgcgaaagatcagaaattctataaaggtattatcaagaagctcaagaataagatccaaaaatctgagttaaaggcggaaacacacaaggggctttattcgcctactgaatcccttcagttgctcgaatggttagttcgtcgtggtgacatcaagctgacatacctcgaaatcggcaaggagaacgagaagctcaacgaactcgttcctttggtagagcttaaggacattcatcgcaatttcaacaatttcgctacatacttaagtgggttctctaaaaatcgcgaaaatgtctattcaaccaagtttgaccgtcgctcgggctataaagcaacatctgtcattgcgcgtacatttgaacaaaacttgatgttttgtttggggaacattgcaaagtggcataaagtgacagagtttatcaaccaagccaataattacgagctccttcaagagcatggtattgattggaataagcagatcgctgcattggagcataaactcgatgtttgcttggcggagttttttgctttaaataatttctcacaaacacttgcacagcagggcatcgaaaagtataatcaggtactggccggtatcgcggagatcgccgggcaacctaaaacccaaggtcttaatgagttaatcaatctcgcccgccagaagctcagtgcgaagcgctcccaattgccaacgcttcagcttctttataaacagattctcagcaagggtgacaaaccgttcatcgatgactttaaatcggaccaggaactgattgcggaacttaacgagtttgtatcatcgcaaatccacggcgagcatggtgcgattaaacttatcaaccacgaattagagagctttatcaacgaggctcgcgctgcgcaacaacagatctatgtcccaaaggacaagttaacggagctttccttattgctgacgggttcttggcaagcgattaatcaatggcgttataagttatttgaccagaagcaactggacaaacagcaaaagcagtacagcttttctcttgctcaggtcgagcgttggctggcgacggaggttgagcagcagaacttttatcagacggagaaagagcgccagcaacacaaagatacgcagccggctaatgttactacaagctctgacggccatagtattttaaccgcctttgaacaacaggtacagacacttcttaccaatatttgtgtcgccgctgagaaatatcgtcaactctccgataacttaaccgcgattgacaagcagcgcgagtctgagtcgagtaaaggcttcgaacagatcgccgtaatcaaaacattgctcgatgcgtgtaatgagttaaaccattttcttgcacgttttactgtaaacaaaaaagacaagttgcctgaagaccgggccgaattctggtacgagaaactgcaagcctatatcgatgcttttccaatttacgaattgtacaacaaggtccggaattatttgtccaaaaaaccattctctaccgaaaaagtgaagattaattttgacaattctcattttctgtcgggctggaccgccgattacgaacgccatagcgccttgctgtttaaattcaacgagaactaccttttgggcgtggtaaacgaaaatctctcatccgaagaagaggagaaattgaaattagtcgggggcgaagagcatgcgaaacggtttatttacgattttcagaaaatcgacaacagtaacccacctcgtgtgtttattcggtcgaagggctctagttttgctcctgctgttgaaaagtaccaattaccgattggcgatatcatcgacatctatgatcaagggaaattcaagacagagcataaaaaaaaaaatgaggccgagtttaaggacagtttagtacgtcttatcgactatttcaagttgggcttctcccggcatgatagttacaagcattatcctttcaagtggaaagcgtctcaccagtatagcgacattgctgaattttacgcgcatacggcttcattctgctatacgttgaaggaagagaacatcaattttaacgtgcttcgtgagttatctagtgccgggaaggtctatcttttcgaaatttacaacaaggatttcagcaagaataagcgggggcaagggcgggataacttgcacacgtcgtattggaaactcttattcagcgcggagaatttaaaagacgtggtgcttaaactcaatggccaggccgaaatcttctaccgtcctgcaagcctggctgaaacaaaagcgtatacccacaaaaagggtgaagtcttgaagcacaaggcttacagcaaagtatgggaggctttagactcacctattggcacgcgtctgtcttgggacgatgctttaaaaatccctagcatcaccgaaaaaacgaaccacaataatcaacgtgtggtacagtataacgggcaggagattgggcgcaaggcagagttcgcgatcattaaaaaccgtcgctattcggtagataaattccttttccattgccctattacgctgaacttcaaggctaatgggcaagataacattaacgcacgtgtaaaccagttcttggcgaataacaagaaaatcaatatcattggtatcgaccggggcgaaaagcatcttctgtatatttctgttatcaaccagcagggtgaggtgcttcaccaggaatcgtttaatacaatcaccaattcttaccagacggctaatggtgaaaaacgtcaagtagtcacagactaccaccagaagttagacatgtcagaggacaaacgtgacaaggcgcgtaaatcatggtcaactattgagaacatcaaggaacttaaggctggctacctctcccacgtcgtccaccggttagcgcaattgattatcgagttcaacgctattgtagcgctcgaggacttgaatcacgggttcaagcggggtcggttcaaaatcgaaaaacaagtatatcagaagttcgagaaggcgcttattgataagctgagttatcttgcgttcaaggatcgtacaagctgcctcgaaacgggtcactatcttaatgcctttcagctcacatcgaaatttaaggggttcaacaatttgggtaaacaatcaggcattttgttctatgtaaatgctgactacacctcgactacggatccgctgacaggctatatcaagaacgtctacaaaacctatagcagtgtcaaagactctacggagttctggcaacgtttcaattcgatccgctatattgcatccgaaaatcggtttgagttttcgtacgaccttgcagacctcaagcagaagtccctcgagagcaaaaccaagcaaactccacttgcaaaaacgcaatggactgtctcatcgcatgttacccgtagctattataaccagcaaacaaaacaacacgaattatttgaagttaccgcacggattcagcagttattaagtaaagcagaaattagctatcaacatcaaaatgacctgatccctgcactcgcatcctgtcagagcaaagcactgcataaggagttgatctggttattcaactccattctcactatgcgcgtcaccgacagcagcaagccaagcgcaacctccgaaaatgactttattctgagccctgtggcgccatatttcgattcacgcaatttgaacaaacaacttcctgaaaatggcgatgcaaacggggcttataatattgctcgcaaggggattatgttacttgagcggattggtgatttcgtgccagaagggaataagaagtatccagatcttttgattcgtaataatgattggcagaatttcgtccagcgtcctgaaatggtgaataagcagaagaagaaattagtgaaactgaagacggaatattctaacgggagcctgtttaatgatttagcatttaagggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1107 - DNA, 4581 bp, synthetic construct
  misc_feature 1..4581: note = Description of Artificial Sequence: Synthetic polynucleotide
  source 1..4581: mol_type = other DNA
atgggccaccatcatcatcatcatagcagcggcctggtgccgcgcggcagcggtaccatgtctgaccgtctcgacgtacttactaatcaatatccattatccaaaacgctgcgcttcgagttgaaaccagtgggcgctactgcggattggatccggaagcacaacgtcatccggtatcacaacggcaagctcgtcggcaaagatgctatccggtttcagaattacaagtatttaaaaaaaatgcttgatgaaatgcatcggctctttctccaacaggctctcgttttggaacctaacagcaaccaggcgcaagaactcacggcgctgctgcgcgccattgaaaacaactactgcaacaataatgacttgctggctggtgattacccgagtttgagtacagataagaccatcaaaatttcgaacgggttatcaaaattaacaactgatctctttgacaaaaagttcgaggactgggcataccagtacaaggaggacatgccaaatttctggcggcaggatatcgcggagctggaacaaaagttacaagtcagtgcgaatgccaaagaccaaaaattctacaaagggattatcaagaaactcaaaaacaagatccaaaaaagtgagttgaaagctgaaacccataaagggttgtattctccaacggaatctctgcaactgttagaatggctggtccgccgcggcgatatcaagctgacttaccttgagatcggtaaggaaaacgagaaacttaacgaattggtcccgcttgtggagttaaaggatattcaccgcaatttcaacaatttcgccacctatctttccggtttctcgaaaaaccgggagaacgtgtattcgacgaagttcgaccgtcgttcaggttacaaagcaacctccgtgatcgcgcgtacattcgagcaaaacttaatgttctgtctgggcaacattgcaaaatggcacaaagtaacggaatttatcaatcaagcgaataactatgaactgctccaagaacatggtattgactggaataagcagatcgccgcactcgagcacaagttagacgtatgtcttgccgagttttttgctttaaataatttttcgcagactctggcgcaacaaggtattgagaaatacaaccaggtgcttgcgggtattgccgagatcgcggggcaacctaaaacgcaagggctgaatgagttgatcaatcttgcacgtcagaagctgagtgccaagcgttctcaacttccaacactgcaactcttgtacaagcaaattttgagtaaaggtgacaaaccgttcattgatgacttcaaaagcgatcaggagttgatcgcggaattgaatgagtttgtaagcagtcaaattcatggtgagcatggcgcgatcaagctcatcaatcatgaattggaatcttttattaacgaagcacgcgctgctcagcagcagatctatgtcccgaaggacaaattgacggaattgtcactgttacttacggggtcctggcaggcgatcaaccagtggcgttacaaactcttcgatcagaaacagttggacaaacaacagaaacaatactccttcagcctggctcaagtcgagcgctggctggcgacagaggtcgaacagcagaatttctaccaaaccgaaaaggaacgccagcagcataaagacacgcagcctgcgaatgtaacaacctcatcagacggccatagcattttgaccgcttttgaacagcaagttcagactcttttgactaatatttgcgtagcagcagagaagtatcgtcaattatcggataatttaaccgctattgacaagcaacgtgagtccgaatcgtccaaggggtttgaacaaattgcagtcatcaagacgttattagatgcctgtaacgagcttaatcacttccttgcacggtttacagttaacaagaaggacaaacttccggaagaccgtgctgaattttggtatgaaaagctccaggcttacatcgacgcttttccgatttacgagctttacaataaagtgcgcaactacctctcgaagaaaccgttcagtaccgagaaggtgaagatcaattttgacaattcacactttctgtctggctggaccgccgattacgagcggcatagtgcgttactctttaagttcaacgaaaattacttgttaggcgtggtgaacgaaaatttgagttcggaggaggaagaaaagcttaagttagtcggcggggaagagcacgcgaaacggtttatttatgacttccagaaaatcgacaattcgaatccacctcgtgtatttatccgttctaaaggctcatcattcgcaccagccgtggaaaagtatcaactcccgattggcgacatcattgacatttatgaccagggcaaatttaaaacggaacacaagaagaaaaacgaagccgagtttaaggactcgttagtccgcctcatcgactatttcaagctgggcttctcacgccatgactcttataaacactaccctttcaaatggaaagcgtctcaccaatattctgatattgcagaattttacgcccacaccgcatcattctgctatacgctcaaagaggaaaatatcaattttaacgtactccgggagctctcaagcgcagggaaggtctacctcttcgaaatctacaataaggatttctccaaaaacaagcgtggccaagggcgggacaacctccacacgtcttactggaaactgttatttagcgcagagaaccttaaagacgtggtgctgaaattgaacggccaggcggagattttctatcggcctgcatctctggctgagactaaagcgtatactcacaagaagggtgaggtgttaaagcataaggcatacagtaaagtgtgggaagcactggactctccgattggcacacgcttatcgtgggatgatgcgctcaagattccgtctatcacggagaagactaatcataataatcagcgggtcgtccagtataatggtcaggagattggtcgtaaggcagaatttgcgattatcaagaaccgccggtacagcgttgacaaatttctgtttcattgtcctatcacgctgaacttcaaagcgaacggtcaggataatatcaacgcgcgcgtaaaccaatttttagcaaacaataaaaaaattaatatcatcgggattgaccggggggagaaacacctcttatacatcagtgtcatcaaccaacaaggcgaggtgttacaccaagaaagcttcaatacgatcactaattcctaccagactgctaacggggaaaaacgtcaggtggttactgattatcatcaaaaacttgacatgtctgaagacaagcgtgacaaagcgcgcaagtcctggagcacgattgagaacattaaggagctcaaggcgggttacttatctcacgtcgtccatcggctggcacagcttatcattgagtttaatgctattgttgccctcgaggacctcaaccacgggtttaaacgtggccgctttaaaattgaaaagcaagtttatcaaaaattcgaaaaggcgttaattgacaagctcagttacctggctttcaaggaccggacaagttgtctggagaccgggcattatcttaacgcctttcaacttacgtcgaaattcaaaggttttaacaatttagggaagcagtcgggcattttattctacgtcaacgcggattacacatcaactacggatcctttgacgggttatatcaagaacgtatacaaaacttactcgtctgtaaaggatagcaccgagttttggcaacgcttcaattccattcggtatatcgcttcggagaatcgttttgaattttcgtatgacctggccgacctgaagcaaaagagtttagaatcgaagactaagcaaacgccgctcgctaagacacaatggactgtctctagtcatgttacccggtcctactataaccagcagacaaaacagcacgagttattcgaggtcaccgcacggatccagcaattgttatcaaaagctgaaatcagttatcagcaccagaacgaccttattccggccctggcgtcttgtcagagcaaagctctgcacaaggagctcatctggctttttaatagtattttgaccatgcgggtcaccgacagctccaaaccatccgcaacctccgaaaatgattttatcctgagcccggtcgcaccatactttgactcccgcaacctcaacaaacaacttcctgaaaatggtgatgcgaatggcgcttataacatcgctcggaaaggcatcatgctgcttgagcgcattggtgattttgtacctgagggcaacaaaaagtatccggatttgttgattcgcaataatgactggcagaacttcgtacagcgtccggagatggtgaataagcagaaaaaaaagctggtgaaactcaagacggaatactctaacgggtcgctgtttaacgatctggcttttaagggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1108 - DNA, 4581 bp, synthetic construct
  misc_feature 1..4581: note = Description of Artificial Sequence: Synthetic polynucleotide
  source 1..4581: mol_type = other DNA
atgggccaccatcatcatcatcatagcagcggcctggtgccgcgcggcagcggtaccatgagtgaccggttggacgtgctgacaaaccaatacccactgagtaagacgttgcgtttcgaactgaaaccggtgggggccactgctgattggatccgtaagcacaacgtaattcgctaccataacggtaagcttgtaggcaaggacgccattcgcttccagaactacaaataccttaagaaaatgttggatgagatgcaccgcctgttcctgcaacaggcgctggttttagagccgaattccaatcaggcccaagagctgacggctttgttacgtgccatcgaaaacaattattgtaacaacaacgacctcttggcaggggattatccgagcttaagtacagacaagacgatcaagatttcgaacggtctttcgaagttaactacagatctgtttgacaaaaaattcgaggattgggcctaccaatataaggaagatatgcctaacttttggcgtcaagacattgccgagcttgaacaaaaactgcaagtaagcgcaaacgcgaaggaccagaagttctataaagggatcatcaagaaactcaagaacaagatccaaaagtcagaactcaaagctgagacgcataagggcctgtattctccgacagaatcactgcaactcttggaatggcttgtacgccgcggcgatattaagctgacgtaccttgagatcggtaaagaaaatgagaagctcaatgaactggtgcctctcgtagagttgaaggatatccatcggaacttcaacaatttcgccacgtatctttccggcttttcgaaaaaccgtgaaaatgtttacagtacgaaatttgatcggcgttcagggtacaaagcgacgtcagtaattgcccggaccttcgaacagaatttgatgttctgcttagggaacattgctaagtggcacaaagtcactgaatttatcaatcaggccaataattacgaattattacaggaacatgggatcgattggaacaaacaaattgctgctctggaacataagcttgatgtctgtctcgctgagttcttcgcgctgaacaacttttcacaaactctcgcgcagcaagggattgaaaagtacaatcaagtattagcgggcattgcagagattgctggtcagccaaagacccaaggccttaatgaattaattaatttagcccgccaaaagctgtcagccaaacgcagtcagctcccgacacttcaattattatacaagcaaattttatcaaagggcgataaaccgttcattgatgactttaagtcggatcaagagctgattgcggaactgaacgaatttgtgagctctcaaatccacggcgaacatggtgctatcaagttaattaatcatgaactcgagtcgtttatcaatgaggctcgtgccgcacaacagcagatttacgttccgaaggacaaactcactgagttgtctttgcttctcactggttcgtggcaagctatcaatcaatggcgctacaaactgttcgaccaaaaacaactcgataaacaacagaagcagtacagcttctcactggcgcaagtagaacggtggcttgctacggaggttgaacaacagaatttctaccagacagagaaagagcgccaacagcacaaggatacccaaccagcaaacgttacgacctcgagcgacggccacagtattctgacagctttcgagcagcaagttcaaactctgctcacgaacatttgtgtggcagcagagaaataccggcaattatcggataacctcacggcaattgacaaacaacgggaaagcgagtcaagtaagggtttcgagcaaatcgccgtaattaaaactctgctcgatgcgtgtaatgaactcaatcatttcttagcgcggttcacggtaaacaaaaaagacaagttgcctgaagaccgggcggaattctggtatgagaaactgcaggcttacatcgatgcttttccaatttacgaactctacaacaaagttcgcaactatcttagtaaaaaacctttctcgaccgaaaaggttaaaatcaatttcgacaattcacactttttgagtggctggacagcggattatgaacgccattctgcactcctgttcaagttcaatgagaactaccttcttggggtcgttaacgagaacctttctagtgaggaggaagaaaagttaaagctcgtggggggcgaagagcacgcgaagcgctttatctacgactttcaaaaaattgataattccaacccgccacgcgtctttatccggtccaaaggcagcagttttgctcctgcagtcgaaaagtatcaactccctatcggtgatattattgacatttatgatcaaggcaagtttaaaactgagcacaaaaaaaagaacgaggccgagtttaaggactccctggttcgccttatcgactattttaagttgggtttcagccggcacgactcatataagcactacccattcaaatggaaggctagccatcaatattctgatattgccgagttctatgcgcacacagcatccttctgttatactctgaaggaggagaatattaatttcaacgttctgcgcgagttaagctcagcgggcaaggtctacttattcgaaatctacaacaaggatttcagtaaaaataaacggggccaggggcgggataatctccacacgagttattggaaactcttattctcggcggagaacctcaaagacgttgttttaaaattaaatggccaggctgaaatcttctaccgtccagcaagtctggctgaaactaaagcctatacccacaagaaaggggaggttctgaaacataaagcctactcgaaagtctgggaagccttagactcccctattgggactcgtctttcatgggatgatgcgctgaagatcccgagcattacggagaagacaaatcataataaccagcgggtggtgcagtataacgggcaggagatcggtcgtaaagccgaatttgcgattattaagaatcgtcggtattcggtggacaagtttttatttcactgtccgatcacattaaacttcaaagcgaatgggcaggacaacattaatgcccgcgttaaccaattccttgcaaataacaaaaagattaatattatcgggatcgatcgcggtgaaaagcatttgttgtacatctctgtcatcaaccagcagggggaggtgctgcatcaagaatcgtttaacacaattaccaactcatatcagaccgcgaacggggagaaacgccaagttgtgacagactaccatcagaagctggatatgagtgaggataaacgggataaagcgcgtaaatcgtggagcacgattgagaatattaaagagttgaaagcagggtacttaagtcacgtcgttcatcggctcgcccaactcatcatcgaattcaacgcgatcgtggcgttagaggacctcaaccatgggttcaaacgcggtcggttcaagattgagaagcaggtatatcagaaattcgagaaagctttaatcgacaaactgagttatctcgccttcaaggaccgcacgtcgtgcttggaaacggggcactatctgaacgcgttccaactgacatcgaaattcaaaggttttaacaacttgggcaagcagagcggcattctgttctatgtcaacgcggactacacctctaccacggacccgcttacggggtatatcaaaaacgtatataagacatattcgtcagtaaaggattccacagagttctggcaacgctttaacagtattcggtacattgctagcgagaatcggtttgaatttagctacgatttggcagacttgaagcaaaagtctttggaatctaaaactaagcaaactccgcttgctaaaacccaatggacagtttcttcccatgttacccgttcctactataatcagcagacaaaacagcacgaattgtttgaagtcaccgcacgcattcagcaattgttatcaaaggccgagatctcgtatcagcatcagaacgacttaattccagcattagcgtcctgccagagcaaagcgttacacaaagagctgatctggctttttaattctatcttaactatgcgggtgacggactcgtcgaagccgtcagcgacgagcgagaacgattttatcctgagtccggtggctccgtattttgatagccgtaatctcaacaaacaattgccggaaaatggcgatgctaatggtgcctacaacatcgcccgcaaaggcatcatgctgttggagcggatcggggactttgtgcctgagggcaataaaaaatatcctgaccttctcattcgtaataacgattggcaaaatttcgtgcagcgccctgagatggttaacaaacagaaaaagaagctcgtgaagctgaagactgagtacagtaatggctcattgttcaatgatttagcctttaaaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1109 - DNA, 4581 bp, synthetic construct
  misc_feature 1..4581: note = Description of Artificial Sequence: Synthetic polynucleotide
  source 1..4581: mol_type = other DNA
atgggccaccatcatcatcatcatagcagcggcctggtgccgcgcggcagcggtaccatgtcggatcgcctcgatgtacttacgaatcagtatccgttgtcaaagacgcttcggtttgagttgaaacctgttggtgccacagcggactggattcggaaacataacgtgattcgttatcataacggtaaactcgtaggcaaagacgcaattcgctttcagaattataagtatcttaaaaagatgctcgacgaaatgcatcggctttttttacagcaggcacttgtgctcgaaccgaattcgaaccaagcacaagaacttacggcgctgctccgggcgattgaaaataactactgcaacaacaatgacctcctggctggcgactatccgagtctcagcactgacaaaacgatcaaaatcagcaacgggctctccaagctgacaactgacctgttcgataaaaagttcgaagattgggcatatcagtataaggaggacatgccaaacttctggcggcaagatatcgcagagcttgagcagaagttgcaggtcagcgccaacgcaaaggatcaaaagttttataagggcatcatcaagaagctcaaaaataagatccagaaaagcgagctgaaagccgaaacgcacaaggggttgtacagtccaacggagagtctgcaactcttggaatggcttgtacggcgcggggatatcaagcttacatatttagagatcgggaaagagaatgagaaattgaacgagttagttccactcgtagagcttaaagacatccatcgcaatttcaataactttgctacctatctttcggggttttcaaaaaaccgcgagaacgtgtattcgacaaaattcgatcgtcgcagcgggtataaagcaacatccgtcatcgcccgtacctttgaacagaatttgatgttttgtttagggaacatcgccaagtggcacaaggtgactgaattcatcaatcaggccaataattacgaacttctccaagaacacgggattgattggaacaaacagatcgcagcgttggagcacaagctggacgtatgtctcgccgaattctttgcactcaataatttttctcaaaccctcgcacaacaaggtatcgagaaatacaaccaggtgcttgcggggattgcagagattgctggccagcctaaaacgcaaggtctgaacgagcttattaaccttgcacggcaaaagttaagcgcgaaacggagtcagttgccaactcttcagctcctttataagcagattctttctaagggtgataagccattcatcgacgatttcaaatccgatcaagaattgatcgcagaattgaatgaattcgtctcgtctcagattcatggcgagcatggcgccattaagcttattaaccatgagttagagagttttattaacgaagcacgggctgcccaacagcagatctatgtcccaaaagacaagctcaccgaactttctctcctgttaacgggttcatggcaagcaattaatcagtggcggtataaattgtttgatcaaaagcaacttgacaaacaacaaaagcaatactccttttctttggcgcaagtggaacgttggttagcaacagaagtagaacagcagaatttttatcagacagaaaaggagcgccaacagcacaaagacacccaaccggctaacgtaacaacgtcgtcagacgggcattcaattttaacagctttcgagcagcaggtccaaactttgttgaccaacatctgcgtagcagcagagaaatatcgccagttgagtgacaatttgacggcgattgataagcaacgggaaagcgaatcctctaaaggttttgagcaaatcgctgtcatcaagaccttattggacgcgtgtaacgaactgaatcattttttggcacgctttacggtcaacaagaaggataagctgcctgaggatcgggcagagttttggtatgagaagctccaagcttacattgacgcatttccaatttatgaattatataataaagtgcgcaattatctgagtaaaaagccattctctactgaaaaagtgaagatcaactttgacaactcacactttctgtccggttggacagccgattacgaacggcactcggccttactttttaagttcaatgaaaattatctgttaggcgttgtcaacgagaacctctcgagtgaggaggaagaaaaacttaaattggtaggcggtgaagagcatgcgaagcgcttcatctacgatttccagaagatcgacaactcaaacccacctcgcgtcttcatccgttctaaaggtagctcatttgcgcctgccgttgaaaaatatcagctccctattggcgatatcatcgacatttatgatcaggggaaattcaaaacggagcacaagaaaaaaaacgaggcggaattcaaagattctttggttcgtttgatcgactattttaagctcggttttagccggcacgacagttacaaacactacccatttaagtggaaggcgtctcatcaatattctgatatcgcggagttctatgcccacacggcgagcttctgctacaccctcaaggaggagaatattaatttcaacgtactgcgcgaactcagttcggcaggtaaagtataccttttcgagatttataacaaagactttagtaagaataagcgtggtcaaggccgggacaaccttcatacatcttattggaagcttctttttagtgctgaaaatctcaaagacgtcgtcttaaagctcaatggtcaggcggagattttctatcgtccagcaagcctcgcagagaccaaagcatacacgcataagaaaggtgaagtgcttaaacataaggcctattcaaaagtatgggaagctctggacagcccaatcgggacgcgcctcagctgggatgacgcgcttaaaatcccaagtatcacagagaaaacgaatcacaataaccagcgtgtagtgcagtataacgggcaggagattggtcgcaaagccgagttcgcaatcattaaaaaccgtcgctatagtgtggataagttccttttccattgtccgattaccttgaatttcaaggctaatggccaggacaacatcaacgcccgtgtcaatcaatttttagccaacaataagaaaattaatatcatcggcatcgatcgcggcgagaagcatttgctttatatctcggtaattaaccagcaaggcgaagttctccaccaagagtcattcaatactatcaccaacagttatcagacagccaacggtgagaaacgccaagtagtgacagactaccaccagaagctcgatatgagtgaagataagcgtgataaagcccggaagtcctggtcgacaatcgaaaatattaaagaacttaaggcgggttatctctcacacgtggtccaccgtttggcacagctcatcatcgaatttaacgcaatcgtagccttggaggatcttaaccacggtttcaagcggggtcgtttcaaaatcgaaaaacaggtgtatcagaagttcgagaaagcattaattgacaagctgagttatttagcgttcaaggaccgtactagttgtttggagactggtcactacttaaatgcgttccagcttacctccaaatttaagggctttaataaccttggtaagcagtcgggcatcttgttttacgttaacgccgattacacgtccactacagacccactcactgggtatattaaaaacgtctataaaacgtatagcagtgtgaaggactctacggagttctggcaacgctttaactctattcggtatatcgcatccgaaaatcgctttgaattctcctatgacttggcagatttaaaacaaaaatctctcgagagtaaaacaaagcaaacacctctcgcaaaaactcaatggacagtttccagccatgtcactcggtcctattacaaccagcagactaaacaacatgaattattcgaagtcacggcccgcattcaacagctgcttagcaaagcggaaattagttaccagcatcagaatgacttaatcccagcacttgcgtcgtgtcagagtaaggctctccacaaagagcttatttggttattcaactcaattctgactatgcgggtgactgatagtagtaaaccgtctgcgactagtgagaacgatttcatcctttcgcctgttgcgccgtatttcgactctcggaaccttaataaacagttaccagagaacggcgatgccaatggtgcttacaatatcgcacggaaagggattatgcttctggaacggattggcgatttcgtaccagaaggtaacaaaaaatatccagacctgctcatccggaacaacgattggcagaactttgtacaacgccctgagatggtgaataagcaaaaaaagaagctcgtcaagctgaagacagagtacagcaacgggagtttatttaatgatttagcattcaaaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1110 - DNA, 4581 bp, synthetic construct
  misc_feature 1..4581: note = Description of Artificial Sequence: Synthetic polynucleotide
  source 1..4581: mol_type = other DNA
atgggccaccatcatcatcatcatagcagcggcctggtgccgcgcggcagcggtaccatgtccgaccggctggatgtactcactaatcaatatccgttatccaagacattacggttcgagttgaaaccagtaggggccacagcggactggattcgtaaacacaatgtaatccgctatcacaacggcaagttggtggggaaagacgcaattcgctttcagaactataagtatcttaaaaaaatgttagatgaaatgcaccggcttttcctgcagcaggcactggtgctggagccgaactccaatcaagcccaggaactgaccgcattgttacgtgcaatcgaaaacaattattgtaataataatgatttgttagctggtgactatccatcgctttcaaccgataagaccattaagatctcaaacggcttaagcaaattaacgaccgatctgttcgataaaaagttcgaagattgggcctatcagtataaagaagacatgccaaacttctggcgccaagacattgccgaactcgaacagaaactgcaagtatcggccaacgctaaagaccaaaagttttataaaggtatcatcaaaaagcttaagaacaagatccagaaaagtgagttgaaagcagaaactcataaagggctgtattccccaactgaatccctgcaactcttggaatggctcgttcgccggggcgacattaaattgacgtacttagaaattggtaaggaaaacgaaaaactcaacgagttagtaccgctcgttgaactcaaagatattcatcgtaactttaacaactttgcgacttacctctcaggcttcagcaaaaatcgtgaaaatgtatactcgactaagttcgatcggcggtccggttacaaggccacatccgttatcgctcgcacttttgagcaaaacctcatgttttgtcttggcaatattgctaaatggcataaagtcacagaattcattaatcaggctaataactacgaacttttgcaagaacacgggatcgactggaataagcaaattgctgccttggagcataaattagatgtgtgccttgcagaatttttcgcgctgaacaatttttcgcagacattagcgcagcagggcatcgaaaagtacaaccaggtgctcgcggggattgcagaaatcgcaggccaaccaaaaacacagggtctcaacgagctgatcaacttagctcggcaaaagttgtccgctaagcgctcacaacttccgaccttgcaactcctgtataaacaaatcctctcaaagggcgataagccttttatcgatgattttaaatcggatcaagaactgatcgcagagttaaacgagttcgtgagtagccagattcacggtgagcatggcgctattaaactcatcaaccacgaactggagagctttatcaatgaggctcgcgcagcgcagcagcagatctatgtaccaaaggataaacttacagaactgtcgttgctcctgacggggtcatggcaggcaattaaccagtggcggtataaattgttcgaccagaagcaattagacaagcaacaaaagcaatattccttcagcctcgctcaggtcgagcgttggctggctacggaagtcgagcaacagaacttttaccaaacggagaaagaacgccagcaacataaagatacgcagccagctaatgtcacaacctcttctgatgggcactcaatcctgaccgctttcgaacaacaagtccaaactctgttgacgaacatttgtgtggctgcggagaagtaccggcaactgagtgacaaccttactgcaatcgataagcagcgtgaatccgagagttctaaggggtttgagcagattgcggttatcaaaacacttctggacgcctgcaacgagctgaaccatttcctggctcgcttcactgtcaacaagaaggataagctgccggaggatcgcgctgaattctggtatgagaagctgcaggcgtacatcgatgcgttcccaatctacgagttgtacaacaaggtccgtaactacctttcgaaaaaaccattctcaactgagaaagtaaagatcaattttgacaattctcacttcttgtcgggctggaccgccgattatgaacgtcattctgcccttctcttcaaattcaacgagaattatcttttgggggttgtaaatgagaacttgagctccgaggaagaggaaaagttgaaacttgtcggtggtgaagaacatgcaaaacgctttatctatgacttccaaaaaatcgacaacagtaaccctccacgggtgttcatccggagcaagggtagttcttttgcaccggccgttgaaaaatatcaattgccaatcggggacattattgatatttatgaccaagggaagtttaagaccgagcacaagaaaaaaaatgaagccgagttcaaggatagtttggtgcgcttgattgactattttaagctgggtttcagtcgccacgacagctacaaacactatcctttcaaatggaaggcctctcaccaatattctgatatcgctgaattctacgcccatacggcttccttttgctacacacttaaagaggagaatatcaattttaacgttctccgggagttatcctctgctgggaaggtttacttatttgaaatttacaacaaagatttctctaagaacaagcgtggccaaggccgcgacaacctccatacctcctactggaagctcttgttctccgcagaaaatttgaaggatgttgtccttaaacttaacgggcaagccgagatcttctaccggccagcgagtctggccgaaactaaggcttatactcataaaaagggcgaagtcttgaaacacaaggcatactcaaaggtttgggaggcccttgacagccctattggcacgcggttgtcatgggacgacgcacttaaaatcccttcaatcaccgaaaagacgaaccataacaatcagcgcgtggtgcaatataatggccaagaaatcggtcggaaagccgaattcgcgatcattaagaaccgccgttatagcgtggacaaattcctctttcactgtccaatcacattaaacttcaaggcaaacggtcaagataacattaacgcgcgtgtaaatcaattcctcgcgaataacaagaaaattaacatcatcgggattgatcgtggtgagaaacatctgttatatatctctgtcattaatcagcagggcgaagtacttcaccaggagtcctttaataccatcacgaatagctaccagacggcaaatggcgagaagcggcaggtggttacagactaccatcagaaactggatatgtccgaggataagcgggacaaagcgcgcaagagctggtccactatcgagaacatcaaggagttaaaagctgggtaccttagccacgtcgtacatcgcctcgcacagttgattatcgagttcaatgcaatcgttgcgttggaagacttgaaccatggttttaagcggggtcggtttaagatcgaaaagcaggtgtatcaaaaatttgaaaaagcactgatcgataagctgagttatctcgcattcaaagatcgcactagctgtctggagactggccactacctcaatgcctttcaactgacctcaaagttcaaggggtttaataatcttgggaaacaaagtggtattttgttttatgttaatgcggattacacttcaactaccgatcctctgaccgggtatatcaagaacgtctataaaacgtacagtagcgtcaaggacagtacggagttctggcaacgcttcaacagtattcggtatattgcgtcggagaaccggtttgaattctcttatgacctggcggatctcaagcagaaaagcctggaatccaaaacaaaacagactccgctcgccaagacacagtggacggtttcatcgcacgttacgcggtcatactataaccaacagacgaaacaacacgagcttttcgaagtaactgcacgtatccagcagttgctgtcaaaggcggagatttcctatcagcaccaaaacgaccttatcccggcactcgctagttgccaaagcaaagcgcttcataaagagctgatctggctcttcaatagtatcttaaccatgcgtgtaactgacagcagtaaacctagcgccacaagcgaaaacgactttatcttaagccctgtagcaccttatttcgattcacgcaatttgaataaacagctgcctgagaatggcgatgcaaacggtgcgtataatatcgcccggaagggcatcatgttattggaacggattggcgatttcgtcccggaggggaataagaagtatcctgatctcttaattcgtaataatgattggcaaaattttgtgcaacgccctgagatggtgaacaagcagaaaaaaaaactggttaagttaaaaactgaatattcaaatggtagcttgtttaacgacttagcatttaagggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1111 - DNA, 4581 bp, synthetic construct
  misc_feature 1..4581: note = Description of Artificial Sequence: Synthetic polynucleotide
  source 1..4581: mol_type = other DNA
atgggccaccatcatcatcatcatagcagcggcctggtgccgcgcggcagcggtaccatgtccgaccgtttagatgtcttgactaaccagtatccactctcgaagacactccgtttcgagttaaaacctgtaggcgcaacggcagactggattcggaaacacaatgtcatccgctatcacaacggcaagttggtgggcaaggatgcgattcggttccagaattacaagtatctcaaaaaaatgctcgacgagatgcatcgcctgtttctccagcaggctttagtattggaaccaaactccaatcaggcacaggagttgacggccctcttgcgtgctatcgagaataattattgtaataacaatgacctgttggcgggtgactacccgtctttatcaacagacaaaacgattaaaatttccaacgggttgtccaaattaactaccgatttattcgacaagaaattcgaggactgggcctatcagtacaaagaagacatgcctaatttctggcgccaggacatcgcagaattggaacaaaagcttcaagtctccgcaaacgctaaggaccaaaaattctataagggtattatcaagaagctcaagaataaaattcagaagtcagaattaaaggccgagacgcacaaaggtctttattcccctactgaatcgcttcaattacttgagtggttggtgcgtcgtggtgatatcaagttaacgtacctggagattggcaaagagaatgaaaaactgaacgagttggtacctttagtggaattaaaggacatccaccgcaactttaacaacttcgctacatatcttagcgggttctctaaaaaccgggagaacgtctattctacgaaattcgatcgtcgtagcggctacaaggcgacaagcgtcattgctcgtacattcgaacagaacctgatgttctgtctgggtaacatcgccaaatggcacaaagtaaccgaattcattaaccaggccaataactatgaattattacaggaacacggcattgattggaacaagcagatcgccgccttagagcataagctggacgtttgccttgcggaattttttgcgttgaacaatttcagtcaaaccttagcccaacaggggattgaaaagtataatcaggtgttggctggtatcgcagaaatcgcggggcagccaaaaacccaaggcctcaacgagctcattaacttggctcgtcaaaagttgtcggcgaagcgtagccaactgccgaccctccagttattatataaacagattctgagtaaaggcgacaagcctttcattgacgatttcaagtcggatcaagagctcattgccgagttgaatgagtttgtgagctcccaaattcacggtgaacacggtgcgatcaaattgattaaccacgagttggagtcgtttattaatgaggcacgggcggctcaacaacaaatttacgtaccaaaagacaaacttactgagctgtcccttcttctcacggggtcatggcaagccatcaatcaatggcggtataaactgtttgatcagaagcagctcgacaaacaacagaagcagtattcgttttcgctcgcgcaagtggaacgctggctcgcgactgaagttgaacaacaaaacttctaccagacagaaaaagagcgccagcagcacaaggacacccaacctgcgaacgtaactacgagttccgatggtcattccatcttaacggccttcgagcagcaagtccaaacgctgctcactaatatctgcgttgccgcagagaagtatcgccaactgagcgataatctgaccgccatcgataagcaacgggagagcgagtcttctaaagggttcgaacagatcgcggttattaagaccctccttgatgcgtgcaacgagcttaatcatttcctcgcgcgttttactgtcaataagaaagacaaattgccagaagaccgcgctgaattttggtacgaaaaactccaggcttatatcgatgccttcccaatttacgaactctacaacaaagttcgcaactacttatccaagaagcctttctctaccgagaaagttaagattaacttcgacaactcgcacttcctttccgggtggacagcggactatgagcggcactctgcgttactttttaagtttaacgaaaattatctgttgggggtcgtcaacgaaaacttaagctctgaggaggaggagaagctcaagttagtgggcggcgaagagcacgctaagcggtttatctacgattttcaaaagattgataatagtaatccacctcgcgtatttattcggtcgaaaggctcttcattcgcgcctgcggtggaaaagtaccagttgcctatcggtgatatcattgatatctacgaccagggtaagtttaagacggagcacaaaaaaaagaatgaggcagagtttaaggacagtcttgttcggctcattgattattttaagttgggtttttctcgtcatgacagctataagcattacccattcaagtggaaggcaagccaccagtactcggacattgcagaattctacgctcatacggcgtcattctgttatacactcaaggaggagaacattaatttcaacgtcctgcgggaattatcgtctgccggtaaagtctatctttttgaaatttacaataaggacttctcgaaaaacaagcggggccaaggtcgcgataatttacatactagttactggaagctgttatttagcgcggagaaccttaaggacgtcgtgctgaaactgaacggtcaggccgagatcttttaccgcccagcgagccttgcagaaacaaaagcttatacacataaaaaaggggaggtgcttaagcataaggcttactcgaaagtgtgggaagcacttgatagccctattgggacccgtctcagctgggacgatgcgctcaaaattccttcgattacggaaaagacgaatcataataatcaacgggtcgttcagtacaatggccaagaaatcggtcggaaagccgagtttgcaattatcaaaaaccgccgttactcggtggacaaattcctcttccattgtccaatcactcttaacttcaaagccaatgggcaagacaatatcaacgcgcgcgtcaaccaatttcttgcaaataataaaaagattaatattattgggattgatcggggtgaaaaacacctcctctacatctcggttatcaaccagcaaggcgaagtgcttcaccaagagagttttaatacgattactaatagctatcagacagccaatggtgagaagcggcaggtggttacggattaccaccagaaacttgacatgagtgaggacaagcgcgataaggcgcgtaagtcatggagtacaattgaaaatattaaagaactcaaagcaggttatttgtcacatgtagtgcaccggttagcccaattgattatcgagtttaatgcaattgtcgcgttggaggacctcaatcacggcttcaagcgcggccgctttaaaatcgaaaaacaggtttatcagaagtttgagaaggctctcattgacaaactgagctatttagcttttaaagaccgtacgtcttgcctcgaaacaggccattatctgaatgctttccaattaacaagtaagttcaagggttttaacaacctcgggaagcaaagtggtattctcttctacgtaaatgcggattacacctccactacggatcctttgacgggctacatcaaaaacgtatacaagacgtactcgtcagttaaggattccacagagttttggcaacgctttaacagtatccgttatatcgcatctgagaaccgtttcgaattcagctacgatttagctgatttaaagcagaaatcgttagagtctaaaactaagcaaacgccacttgcgaagacccaatggacagttagtagtcacgtgacccggtcttattataaccagcaaactaagcagcacgaactctttgaagtgaccgcacggattcaacaactgctttccaaggctgagattagttaccaacatcagaacgacttgattccggcactcgcgagctgtcagtcaaaagctctccataaagagcttatctggctgttcaatagtatcttgacaatgcgtgtcacagattcgtcgaaaccttctgccacgtccgaaaacgatttcatcttatcacctgtagctccttactttgactcccgtaatctgaataaacaactcccagaaaatggggacgcaaacggtgcatacaacattgcgcgtaaaggcattatgttgctggaacgtatcggcgacttcgttcctgaaggtaacaaaaagtacccggatttactgattcgcaataatgattggcagaatttcgttcaacggccagagatggtcaataagcagaaaaaaaaattggtgaaactgaagactgaatatagcaatgggtcgctgtttaatgatttggcattcaaaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1112 - DNA, 4581 bp, synthetic construct
  misc_feature 1..4581: note = Description of Artificial Sequence: Synthetic polynucleotide
  source 1..4581: mol_type = other DNA
atgggccaccatcatcatcatcatagcagcggcctggtgccgcgcggcagcggtaccatgtccgaccggcttgatgtgcttactaaccaatatccgctttccaagaccttacgctttgagcttaaacctgtcggtgccaccgctgactggattcggaaacataacgttatccggtaccacaatgggaaactggtaggtaaggatgcgatccgttttcaaaattacaagtatctgaaaaagatgctggatgaaatgcatcggttgtttttgcagcaagccttggttctggaacctaactcgaaccaagcacaagaactcaccgctctcctgcgcgcaatcgaaaataactactgtaacaacaacgatttgcttgcaggggactatccgtcattgagtacggacaagaccatcaaaatttctaatgggctctcaaaactcaccaccgatttgtttgacaaaaaattcgaggattgggcgtatcaatacaaggaggacatgccgaacttctggcgtcaggatattgcggagttggaacaaaagcttcaagtgtccgcaaacgccaaagatcaaaagttctataaggggatcattaaaaaattgaaaaataagattcaaaagtcggagcttaaggccgaaacacataaagggttatatagcccgacggaaagtctccagctccttgagtggttagtccgccgtggtgatatcaaactcacatacttagaaattggtaaagagaacgaaaaacttaatgaacttgtacctttggtagagttgaaagatattcaccgtaattttaacaatttcgctacatacttgagtgggttctccaagaatcgtgagaacgtatattcgactaaattcgaccgccggtcgggttacaaggcgacttcagttattgcgcgtacgtttgaacagaacttgatgttctgtctgggtaacattgcaaagtggcataaagtcaccgagttcattaatcaggcaaacaactatgagttactgcaagaacatggtattgactggaataagcaaattgcagcacttgaacataagttggacgtatgtctggctgagtttttcgcgctgaataatttctcacaaactcttgcgcagcaaggcatcgagaagtacaaccaggtcctcgccggtatcgcggagattgcaggtcaaccaaaaactcaaggtctcaacgaattaatcaacctggctcggcaaaagttgtcagccaagcgttcgcagttacctacattacaactgttatacaaacagattctctcaaaaggcgataagccgtttattgacgacttcaagtctgatcaagagttgattgcagaactgaacgaattcgtcagcagccaaatccacggggaacatggcgcaattaagcttattaaccatgaactcgagtcgtttatcaatgaagctcgtgctgcccagcaacagatttatgttcctaaggataaactcacagaactgagtttactcctcacggggtcctggcaggcgattaaccagtggcggtacaagctcttcgaccagaaacaactcgacaagcagcaaaagcaatactcattctcgttagctcaagtggaacgctggttggcaacagaagtcgagcaacagaacttttatcagactgagaaagagcgccagcaacataaggatacgcagccagctaatgtcacaacatcctctgacggccactccatcctcaccgcattcgagcaacaggtacaaaccttgttaacaaacatttgcgtcgctgcggaaaagtaccgtcaactgtcggataacttaaccgcaattgataaacagcgcgagtccgaatcgagcaaagggttcgagcagattgcggtaattaaaacgctcttggacgcgtgcaatgagttaaaccactttctcgcacgttttactgttaataaaaaggacaagttgccagaggaccgggctgaattttggtatgagaaattgcaggcctatatcgacgcgttcccaatttatgaactgtacaataaagtccggaactatctttccaagaaaccgttcagtacagaaaaggtaaagatcaattttgataattcacatttcctctccggttggacggctgactatgagcggcatagcgccttattgtttaaatttaatgagaattatttattaggtgtggttaacgaaaatctgtccagtgaagaggaagaaaagcttaaacttgttggcggtgaagagcacgcgaaacgttttatttacgactttcagaaaatcgataatagtaacccaccacgggtcttcatccggtcgaaaggctcgtccttcgctccggcggtggagaagtatcaacttccgatcggggacattatcgatatttatgaccaaggcaagttcaagactgaacacaaaaagaaaaatgaggcggagtttaaagattcacttgtccgcttgatcgattacttcaagctcggcttttcacgtcacgactcatataagcattatccatttaagtggaaggcgtcccaccagtactctgacattgcagaattctacgcgcatacagcttcgttctgctacactttaaaagaagagaatattaactttaatgttttgcgtgaattatcgagcgcagggaaggtttatcttttcgagatttataataaggactttagtaagaataaacgtggtcaaggtcgggataatcttcatacttcttattggaagttacttttctcagcagaaaatttaaaggatgttgtactgaaacttaatggccaagccgaaatcttctatcgcccggcaagcttagcagaaacgaaagcgtacacccacaagaaaggggaggtacttaagcataaagcttactcaaaagtgtgggaggcactcgactccccaattgggacccgcctctcatgggacgatgcattgaaaattccatctatcacagaaaagacaaaccataataaccagcgcgttgtccagtataacgggcaggaaattggtcggaaagccgagtttgccatcattaagaaccgccgttacagcgtagataagttcttatttcactgccctattactctgaacttcaaagccaatgggcaggataacattaacgctcgggttaatcagttcctcgccaacaacaaaaagattaacattatcgggatcgatcgtggggaaaaacaccttctttatatctcggtgatcaatcaacaaggcgaagtgctgcaccaggaaagcttcaatacgattaccaactcttaccaaacggcaaacggcgaaaagcgtcaagttgtaacagactaccaccagaaattagacatgtccgaggataagcgcgacaaggcacgtaagtcttggtcaacgattgaaaacatcaaagagttgaaagccggctacttgagccatgttgttcatcggctcgcccagctgattatcgagtttaacgcgattgtggcactggaagacctgaaccatggcttcaaacgcggccgctttaaaatcgagaaacaggtttatcaaaaattcgaaaaagcccttattgataagttgagttatttagcatttaaagatcggacatcatgtctggaaacagggcactatctcaatgccttccaactcacaagcaaatttaagggctttaataacctcgggaagcaatctgggatcttgttttatgtcaatgcggactatacgtccacgactgaccctttgacggggtacatcaaaaacgtgtataagacgtacagcagtgtcaaggactcgacagaattttggcaacgctttaactcgattcggtacatcgctagtgagaaccgttttgaattttcgtacgatcttgcagatttaaaacagaagtctcttgaatccaaaactaaacaaactccgcttgcgaagacgcagtggacggtttcgtcacatgtaacgcgctcttattataatcaacaaacaaagcaacatgaactgttcgaagtaaccgcccggattcagcagctgctttccaaggctgagatttcctaccaacaccagaacgatctgatcccggctctcgcctcgtgccagagcaaagctctgcataaagagttaatttggctgtttaactcgatcctgaccatgcgggttacagactcttcaaagccttctgcgacatcagagaacgactttatcctgtcacctgtcgctccttattttgattcccggaatttgaacaagcaactcccagaaaacggtgacgcgaatggtgcctataacattgctcgcaagggcattatgctgttagaacgcattggggatttcgtgccggagggcaacaaaaaatacccagacctcttaattcggaataatgattggcaaaactttgttcagcgccctgaaatggtgaacaaacaaaaaaaaaaacttgttaagctgaagacggaatattccaacgggagcctgtttaacgatctcgcttttaaaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1113 - DNA, 4581 bp, synthetic construct
  misc_feature 1..4581: note = Description of Artificial Sequence: Synthetic polynucleotide
  source 1..4581: mol_type = other DNA
atgggccaccatcatcatcatcatagcagcggcctggtgccgcgcggcagcggtaccatgagtgatcggctcgacgttctgacgaaccagtatcctctgtctaagacactccggttcgaattaaagcctgtcggcgcaacggctgattggatccgcaaacataacgttattcggtatcataacggcaaattagtaggtaaagatgcaatccgctttcaaaattataaatatttgaaaaaaatgttggacgagatgcaccgtcttttcttacaacaggccttagttttagagccaaactcaaaccaagcccaggaattaactgcgcttttacgcgcgattgaaaataattattgtaacaataacgatctccttgccggggactatccttcactttcaactgataaaaccatcaaaatcagcaatggtctgtcgaagttaacaaccgacctgtttgacaagaagtttgaggattgggcgtatcaatacaaagaggacatgccaaacttctggcgtcaagatatcgctgaacttgaacagaagctgcaagtgtctgcaaacgccaaagatcaaaagttttataaaggtatcattaaaaagttaaaaaacaaaatccaaaagtccgagttaaaggcagaaacccataaggggttatacagtcctacagaatctctgcaactgttggagtggttggttcggcggggggacattaaattaacatacctggaaatcgggaaagagaatgaaaagcttaatgaacttgtaccacttgttgaactcaaggatattcaccgcaattttaataattttgcaacgtacctctctggtttttccaagaaccgcgagaatgtgtattcgacaaagttcgatcggcggtcggggtataaagcgacttcggtcattgcccgtactttcgagcagaacttgatgttttgcctcggcaacatcgcgaaatggcataaagtgacggagttcatcaatcaggccaataactacgaactgctccaagaacacggcatcgactggaacaagcagatcgcggctctggagcataagttggatgtgtgtcttgcagaattttttgcgttgaataacttttcccaaactcttgcacaacaaggtattgaaaagtacaatcaagttttggctgggatcgcagaaattgctgggcaaccaaagacacaggggcttaatgaacttattaacttggcccgccaaaaacttagcgcgaaacgcagtcagctcccgaccttacagctgctttacaagcaaatccttagcaaaggcgataaaccgttcattgacgacttcaagtccgatcaagagctgatcgcagagctgaatgaatttgtctcgtcgcaaatccacggcgagcatggcgccatcaagcttatcaatcatgaactcgaatcgttcatcaacgaggcccgtgcagcgcagcaacaaatttacgtccctaaagacaaacttactgaattgtctcttttactcaccgggagttggcaagcaattaatcagtggcgctataagctgttcgatcagaaacaacttgacaaacaacagaagcaatacagtttctcgctggcgcaagtcgaacggtggctggctacggaagtagagcagcaaaatttctaccagacagaaaaagaacggcaacagcacaaagatacccaaccagcgaacgttacgacttcctcagacgggcactctattctcaccgccttcgaacagcaggtacagaccctgctcactaatatctgcgtcgccgcagagaagtaccggcaacttagtgacaatcttacggcgattgacaaacaacgggagagtgagtcaagcaagggcttcgagcaaatcgccgtaatcaaaaccttgcttgacgcctgcaatgagcttaaccatttcctggcgcggttcactgtgaataaaaaagacaagctcccagaagaccgtgccgagttttggtatgaaaagcttcaagcatacattgatgcattcccgatttacgaactttacaacaaggtgcggaattacctctctaaaaagcctttcagcacggaaaaagtaaagatcaattttgataattctcactttctctctggttggactgcggactacgagcggcatagtgctttattgtttaagttcaacgagaattatcttctgggcgtggtgaacgaaaacctttcttccgaggaagaagaaaagttgaagctcgttggtggcgaggagcacgcaaagcggtttatttacgattttcagaagattgataactcaaatccaccgcgggtattcatccgcagcaaaggcagttcatttgctcctgcagttgagaaataccaactcccaattggggacatcatcgatatctatgaccaaggcaagtttaaaacagaacacaaaaagaagaatgaagctgaatttaaagactcccttgttcgcttaatcgactactttaagttgggtttcagccggcacgactcctacaagcattacccatttaaatggaaggccagtcaccagtattctgatattgccgaattctacgcgcacactgcaagcttctgttatactttgaaagaagagaacatcaactttaatgtacttcgtgagttatcgtctgcaggcaaggtttatttatttgaaatctacaataaggatttctccaagaacaaacgcgggcaagggcgtgataaccttcatacttcctattggaagttactgttttctgcggagaaccttaaagacgtcgtgttaaagctgaacggccaggccgagatcttttaccggccagcatcgctggcggagactaaggcgtatacccacaaaaaaggtgaagtcctgaagcacaaagcctacagcaaggtttgggaagctcttgattcgccgattgggacgcgtttatcttgggatgacgctttgaagattccaagcatcacggagaaaactaaccacaataatcagcgcgtagttcagtacaatgggcaagagatcggccgcaaggcggagtttgctattatcaaaaatcgtcggtattccgtcgacaaattcttgttccactgcccgattacattgaactttaaggcaaacggtcaagacaatattaacgctcgtgtgaatcaattcctcgctaacaataaaaaaattaacattattgggattgatcgtggggagaagcacctgctgtacatctcagtaattaatcagcagggcgaggtgttgcatcaagagagtttcaatacgatcacgaactcttatcaaacggccaacggggaaaagcgtcaggtcgtaaccgactatcaccagaaactggatatgtcggaggataagcgggacaaggctcgcaaatcctggagcacaatcgagaacattaaagaactgaaggctgggtacttaagtcacgtggttcaccgcttagcccaattgattatcgaatttaatgcgattgtggctctcgaggatctgaaccatggcttcaaacgcggtcggtttaagattgaaaagcaagtataccaaaagttcgagaaggcactgatcgataagctgtcctaccttgcgttcaaagaccgtacctcgtgtttggaaacggggcactatctcaatgcctttcagttgacctcgaagtttaagggctttaataatttagggaagcaaagtgggatcctcttttatgtaaatgctgattacacttcaactaccgatcctttgactggttacatcaagaacgtgtataaaacctatagctccgttaaagactctacggaattctggcagcgcttcaattcaattcgttacatcgcttcagagaatcgctttgaattctcatacgatcttgctgacttgaagcagaaatcgcttgaatcaaaaaccaagcagacgcctttagctaaaactcagtggaccgtgagttctcatgtgactcggagttattataatcagcagactaaacaacacgaactctttgaagtcacggcccggatccaacagctgttatcaaaagccgagattagttaccagcatcagaatgatctgattccagcgcttgcgagctgccagtcgaaggccctgcataaagaattaatttggctttttaactcgatcctgacaatgcgcgtcacagattcttcgaagccaagtgcaactagcgaaaatgacttcatcctcagcccagtagccccttattttgattcgcgcaatcttaacaaacagcttcctgagaacggcgatgcgaacggggcatataatattgcacggaaagggatcatgctgttagagcggatcggtgattttgtaccagaaggtaataaaaagtacccggatttgctcatccggaacaacgactggcagaactttgtccaacgtccggagatggtcaataaacaaaaaaagaagctggttaagctgaaaactgaatattctaatggttcattatttaacgacctggcattcaaaggcgcgccaaaaaggccggcggccacgaaaaaggccggccaggcaaaaaagaaaaaggctagcggcagcggcgccggatccccaaagaagaaaaggaaggttgaagaccccaagaaaaagaggaaggtgtgataa

SEQ ID NO: 1114 - RNA, 56 nt, synthetic construct
  misc_feature 1..56: note = Description of Artificial Sequence: Synthetic oligonucleotide
  source 1..56: mol_type = other RNA
  variation 37..56: note = n=a, c, u, or g
gtctaaaagaccatatgaatttctactttcgtagatnnnnnnnnnnnnnnnnnnnn

SEQ ID NO: 1115 - RNA, 56 nt, synthetic construct
  misc_feature 1..56: note = Description of Artificial Sequence: Synthetic oligonucleotide
  source 1..56: mol_type = other RNA
  variation 37..56: note = n=a, c, u, or g
gtctaaaggccttataaaatttctactgtcgtagatnnnnnnnnnnnnnnnnnnnn

SEQ ID NO: 1116 - RNA, 56 nt, synthetic construct
  misc_feature 1..56: note = Description of Artificial Sequence: Synthetic oligonucleotide
  source 1..56: mol_type = other RNA
  variation 37..56: note = n=a, c, u, or g
gtctatacagacactttaatttctactattgtagatnnnnnnnnnnnnnnnnnnnn

SEQ ID NO: 1117 - RNA, 56 nt, synthetic construct
  misc_feature 1..56: note = Description of Artificial Sequence: Synthetic oligonucleotide
  source 1..56: mol_type = other RNA
  variation 37..56: note = n=a, c, u, or g
gtctgaaagacaagtataatttctactattgtagatnnnnnnnnnnnnnnnnnnnn

SEQ ID NO: 1118 - RNA, 56 nt, synthetic construct
  misc_feature 1..56: note = Description of Artificial Sequence: Synthetic oligonucleotide
  source 1..56: mol_type = other RNA
  variation 37..56: note = n=a, c, u, or g
ggctataagccttgtataatttctactattgtagatnnnnnnnnnnnnnnnnnnnn

SEQ ID NO: 1119 - RNA, 56 nt, synthetic construct
  misc_feature 1..56: note = Description of Artificial Sequence: Synthetic oligonucleotide
  source 1..56: mol_type = other RNA
  variation 37..56: note = n=a, c, u, or g
gttgaaactgtaagcggaatgtctacttgggtagatnnnnnnnnnnnnnnnnnnnn

SEQ ID NO: 1120 - RNA, 56 nt, synthetic construct
  misc_feature 1..56: note = Description of Artificial Sequence: Synthetic oligonucleotide
  source 1..56: mol_type = other RNA
  variation 37..56: note = n=a, c, u, or g
gcatgagaaccatgcatttctaaggtactccaaaacnnnnnnnnnnnnnnnnnnnn

SEQ ID NO: 1121 - RNA, 56 nt, synthetic construct
  misc_feature 1..56: note = Description of Artificial Sequence: Synthetic oligonucleotide
  source 1..56: mol_type = other RNA
  variation 37..56: note = n=a, c, u, or g
gttgagtaaccttaaataatttctactgttgtagatnnnnnnnnnnnnnnnnnnnn

SEQ ID NO: 1122 - RNA, 56 nt, synthetic construct
  misc_feature 1..56: note = Description of Artificial Sequence: Synthetic oligonucleotide
  source 1..56: mol_type = other RNA
  variation 37..56: note = n=a, c, u, or g
atctacaacagtagaaatttaagctaaggcttagacnnnnnnnnnnnnnnnnnnnn

SEQ ID NO: 1123 - RNA, 40 nt, synthetic construct
  misc_feature 1..40: note = Description of Artificial Sequence: Synthetic oligonucleotide
  source 1..40: mol_type = other RNA
  variation 21..40: note = n=a, c, u, or g
taatttctactcttgtagatnnnnnnnnnnnnnnnnnnnn

SEQ ID NO: 1124 - RNA, 64 nt, synthetic construct
  misc_feature 1..64: note = Description of Artificial Sequence: Synthetic oligonucleotide
  source 1..64: mol_type = other RNA
  variation 37..64: note = n=a, c, u, or g
gtctaaaagaccatatgaatttctactttcgtagatnnnnnnnnnnnnnnnnnnnnnnnnnnnn

SEQ ID NO: 1125 - RNA, 63 nt, synthetic construct
  misc_feature 1..63: note = Description of Artificial Sequence: Synthetic oligonucleotide
  source 1..63: mol_type = other RNA
  variation 37..63: note = n=a, c, u, or g
gtctaaaggccttataaaatttctactgtcgtagatnnnnnnnnnnnnnnnnnnnnnnnnnnn

SEQ ID NO: 1126 - RNA, 62 nt, synthetic construct
  misc_feature 1..62: note = Description of Artificial Sequence: Synthetic oligonucleotide
  source 1..62: mol_type = other RNA
  variation 37..62: note = n=a, c, u, or g
gtctatacagacactttaatttctactattgtagatnnnnnnnnnnnnnnnnnnnnnnnnnn

SEQ ID NO: 1127 - RNA, 62 nt, synthetic construct
  misc_feature 1..62: note = Description of Artificial Sequence: Synthetic oligonucleotide
  source 1..62: mol_type = other RNA
  variation 37..62: note = n=a, c, u, or g
gtctgaaagacaagtataatttctactattgtagatnnnnnnnnnnnnnnnnnnnnnnnnnn

SEQ ID NO: 1128 - RNA, 61 nt, synthetic construct
  misc_feature 1..61: note = Description of Artificial Sequence: Synthetic oligonucleotide
  source 1..61: mol_type = other RNA
  variation 37..61: note = n=a, c, u, or g
ggctataagccttgtataatttctactattgtagatnnnnnnnnnnnnnnnnnnnnnnnnn

SEQ ID NO: 1129 - RNA, 61 nt, synthetic construct
  misc_feature 1..61: note = Description of Artificial Sequence: Synthetic oligonucleotide
  source 1..61: mol_type = other RNA
  variation 37..61: note = n=a, c, u, or g
gttgaaactgtaagcggaatgtctacttgggtagatnnnnnnnnnnnnnnnnnnnnnnnnn

SEQ ID NO: 1130 - RNA, 61 nt, synthetic construct
  misc_feature 1..61: note = Description of Artificial Sequence: Synthetic oligonucleotide
  source 1..61: mol_type = other RNA
  variation 37..61: note = n=a, c, u, or g
gcatgagaaccatgcatttctaaggtactccaaaacnnnnnnnnnnnnnnnnnnnnnnnnn

SEQ ID NO: 1131 - RNA, 60 nt, synthetic construct
  misc_feature 1..60: note = Description of Artificial Sequence: Synthetic oligonucleotide
  source 1..60: mol_type = other RNA
  variation 37..60: note = n=a, c, u, or g
gttgagtaaccttaaataatttctactgttgtagatnnnnnnnnnnnnnnnnnnnnnnnn

SEQ ID NO: 1132 - RNA, 61 nt, synthetic construct
  misc_feature 1..61: note = Description of Artificial Sequence: Synthetic oligonucleotide
  source 1..61: mol_type = other RNA
  variation 37..61: note = n=a, c, u, or g
atctacaacagtagaaatttaagctaaggcttagacnnnnnnnnnnnnnnnnnnnnnnnnn

SEQ ID NO: 1133 - RNA, 56 nt, synthetic construct
  misc_feature 1..56: note = Description of Artificial Sequence: Synthetic oligonucleotide
  source 1..56: mol_type = other RNA
  variation 36..56: note = n=a, c, u, or g
gtcaaaagacctttttaatttctactcttgtagatnnnnnnnnnnnnnnnnnnnnn

SEQ ID NO: 1134 - RNA, 44 nt, synthetic construct
  misc_feature 1..44: note = Description of Artificial Sequence: Synthetic oligonucleotide
  source 1..44: mol_type = other RNA
  variation 21..44: note = n=a, c, u, or g
taatttctactcttgtagatnnnnnnnnnnnnnnnnnnnnnnnn

SEQ ID NO: 1135 - RNA, 56 nt, synthetic construct
  misc_feature 1..56: note = Description of Artificial Sequence: Synthetic oligonucleotide
  source 1..56: mol_type = other RNA
gtctatacagacactttaatttctactattgtagatctgatggtccatgtctgtta

SEQ ID NO: 1136 - RNA, 56 nt, synthetic construct
  misc_feature 1..56: note = Description of Artificial Sequence: Synthetic oligonucleotide
  source 1..56: mol_type = other RNA
gttgagtaaccttaaataatttctactgttgtagatctgatggtccatgtctgtta

What is claimed is:

1. A nuclease complex composition comprising a synthetic guide nucleic acid (gNA) comprising:
   (i) a targeter nucleic acid comprising:
      (a) a spacer sequence capable of hybridizing with a target nucleotide sequence, and
      (b) a targeter stem sequence; and
   (ii) a modulator nucleic acid comprising:
      (a) a modulator stem sequence complementary to the targeter stem sequence, and
      (b) a 5' sequence;
   wherein the targeter stem sequence and the modulator stem sequence each comprise 4-10 nucleotides that base pair with each other, and
   the gNA is capable of binding to a CRISPR Type VA nucleic acid-guided nuclease and forming a nucleic acid-guided nuclease complex,
   wherein the targeter and modulator nucleic acids are separate polynucleotides, and
   wherein the targeter nucleic acid or the modulator nucleic acid, or both, comprise one or more modified nucleotides or one or more modified internucleotide linkages at or near its 3' end, at or near its 5' end, or both, and wherein the modulator nucleic acid comprises at least one modified nucleotide and at least two modified internucleotide linkages within the first 10 nucleotides from the 5' end,
   wherein a complex comprising the targeter nucleic acid and the modulator nucleic acid is capable of activating a CRISPR Associated (Cas) nuclease that, in a naturally occurring system, is activated by a single crRNA in the absence of a tracrRNA, wherein the Cas nuclease comprises a Type V-A Cas nuclease, and wherein the nuclease complex retains activity compared to a nuclease complex with the same gNA without the modifications,
   and the Type V-A nuclease.

2. The composition of claim 1 wherein the modulator nucleic acid comprises one to ten phosphorothioate modifications to internucleotide linkages.

3. The composition of claim 1 wherein the modulator nucleic acid comprises at least one modified nucleotide and at least two modified internucleotide linkages within the first five nucleotides from the 5' end.

4. The composition of claim 3 wherein the modulator nucleic acid comprises one to five phosphorothioate modifications to internucleotide linkages between one or more of the first five nucleotides from the 5' end.

5. The composition of claim 1, wherein the Type VA nucleic acid-guided nuclease comprises an amino acid sequence that is at least 80% identical to an amino acid sequence of an ABW, ART, or MAD nuclease.

6. The composition of claim 5 wherein the Type VA nucleic acid nuclease comprises an amino acid sequence that is at least 80% identical to an amino acid sequence of MAD1, MAD2, MAD3, MAD4, MAD5, MAD6, MAD7, MAD8, MAD9, MAD10, MAD11, MAD12, MAD13, MAD14, MAD15, MAD16, MAD17, MAD18, MAD19, or MAD20.

7. The composition of claim 6 wherein the Type VA nucleic acid nuclease comprises an amino acid sequence at least 80% identical to SEQ ID NO: 1.

8. The composition of claim 5 wherein the Type VA nucleic acid nuclease comprises an amino acid sequence at least 80% identical to an amino acid sequence of ART1, ART2, ART3, ART4, ART5, ART6, ART7, ART8, ART9, ART10, ART11, ART12, ART13, ART14, ART15, ART16, ART17, ART18, ART19, ART20, ART21, ART22, ART23, ART24, ART25, ART26, ART27, ART28, ART28, ART30, ART31, ART32, ART33, ART34, ART35, or ART11*.

9. A method of editing a genome of a eukaryotic cell comprising
   (I) delivering to the eukaryotic cell
      (A) one or more synthetic guide nucleic acids (gNA) according to claim 1, or polynucleotides encoding the one or more gNAs, comprising
         (i) a targeter nucleic acid comprising:
            (a) a spacer sequence configured to hybridize with a target nucleotide sequence, and
            (b) a targeter stem sequence; and (ii) a modulator nucleic acid comprising:
(a) a modulator stem sequence complementary to the target stem sequence, and
(b) a 5' sequence;
wherein the targeter stem sequence and the modulator stem sequence each comprise 4-10 nucleotides that base pair with each other, and
the gNA is capable of binding to a CRISPR Type VA nucleic acid-guided nuclease and forming a nucleic acid-guided nuclease complex,
wherein the targeter and modulator nucleic acids are separate polynucleotides, and
wherein the targeter nucleic acid or the modulator nucleic acid, or both, comprise one or more modified nucleotides or one or more modified internucleotide linkages at or near its 3' end, at or near its 5' end, or both, and
wherein the modulator nucleic acid comprises at least one modified nucleotide and at least two modified internucleotide linkages within the first 10 nucleotides from the 5' end;
(B) the Type VA nucleic acid-guided nuclease, or polynucleotides encoding the nuclease;
wherein the gNA and the Type V nucleic acid-guided nuclease form a nucleic acid-guided nuclease complex; and
(II) contacting the genome with the nucleic acid-guided nuclease complex to form one or more strand breaks in the genome.

10. The method of claim 9 wherein the modulator nucleic acid comprises one to ten phosphorothioate modifications to internucleotide linkages.

11. The method of claim 9 wherein the modulator nucleic acid comprises at least one modified nucleotide and at least two modified internucleotide linkages within the first five nucleotides from the 5' end.

12. The method of claim 11 wherein the modulator nucleic acid comprises one to five phosphorothioate modifications to internucleotide linkages between one or more of the first five nucleotides from the 5' end.

13. The method of claim 11 wherein the modulator nucleic acid comprises one to five 2'-O-methoxy modifications to nucleotides within the first five nucleotides from the 5' end.

14. The method of claim 11 wherein the modulator nucleic acid comprises one to five fluoro modifications to nucleotides within the first five nucleotides from the 5' end.

15. The method of claim 9, wherein the Type VA nucleic acid-guided nuclease comprises an amino acid sequence that is at least 80% identical to an amino acid sequence of an ABW, ART, or MAD nuclease.

16. The method of claim 15 wherein the Type VA nucleic acid nuclease comprises an amino acid sequence that is at least 80% identical to an amino acid sequence of MAD1, MAD2, MAD3, MAD4, MAD5, MAD6, MAD7, MAD8, MAD9, MAD10, MAD11, MAD12, MAD13, MAD14, MAD15, MAD16, MAD17, MAD18, MAD19, or MAD20.

17. The method of claim 16 wherein the Type VA nucleic acid nuclease comprises an amino acid sequence at least 80% identical to SEQ ID NO: 1.

18. The method of claim 15 wherein the Type VA nucleic acid nuclease comprises an amino acid sequence at least 80% identical to an amino acid sequence of ART1, ART2, ART3, ART4, ART5, ART6, ART7, ART8, ART9, ART10, ART11, ART12, ART13, ART14, ART15, ART16, ART17, ART18, ART19, ART20, ART21, ART22, ART23, ART24, ART25, ART26, ART27, ART28, ART28, ART30, ART31, ART32, ART33, ART34, ART35, or ART11*.

19. A method of editing a genome of a eukaryotic cell comprising
(I) delivering to the eukaryotic cell
(A) one or more synthetic guide nucleic acids (gNA) according to claim 1, or polynucleotides encoding the one or more gNAs, comprising
(i) a targeter nucleic acid comprising:
(a) a spacer sequence configured to hybridize with a target nucleotide sequence, and
(b) a targeter stem sequence; and
(ii) a modulator nucleic acid comprising:
(a) a modulator stem sequence complementary to the target stem sequence, and
(b) a 5' sequence;
wherein
(1) the targeter nucleic acid and modulator nucleic acids are separate polynucleotides,
(2) a predicted minimum free energy of the targeter stem sequence and the modulator stem sequence as determined by RNAcofold WebServer is between −10 and −4 kcal/mol, and
(3) the gNA is capable of binding to a CRISPR Type VA nucleic acid-guided nuclease and forming a nucleic acid-guided nuclease complex;
(B) one or more Type VA nucleic acid-guided nucleases, or polynucleotides encoding the one or more nucleases; wherein the gNA and the Type V nucleic acid-guided nuclease form a nucleic acid-guided nuclease complex; and
(II) contacting the genome with the nucleic acid-guided nuclease complex to form one or more strand breaks in the genome.

* * * * *